US011389542B1

(12) United States Patent
Poma et al.

(10) Patent No.: US 11,389,542 B1

(45) **Date of Patent: *Jul. 19, 2022**

(54) SHIGA TOXIN A SUBUNIT EFFECTOR POLYPEPTIDES, SHIGA TOXIN EFFECTOR SCAFFOLDS, AND CELL-TARGETING MOLECULES FOR SITE-SPECIFIC CONJUGATION

(71) Applicant: Molecular Templates, Inc., Austin, TX (US)

(72) Inventors: Eric Poma, New York, NY (US); Erin Willert, Round Rock, TX (US)

(73) Assignee: Molecular Templates, Inc., Austin, TX (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/314,563

(22) Filed: May 7, 2021

Related U.S. Application Data

(63) Continuation of application No. 16/467,737, filed as application No. PCT/US2017/065074 on Dec. 7, 2017.

(60) Provisional application No. 62/431,036, filed on Dec. 7, 2016.

(51) Int. Cl.

| | |
|---|---|
| ***A61K 47/68*** | (2017.01) |
| ***C07K 14/25*** | (2006.01) |
| ***A61K 39/00*** | (2006.01) |
| ***C07K 14/195*** | (2006.01) |
| ***A61K 8/99*** | (2017.01) |
| ***A61K 38/16*** | (2006.01) |

(52) U.S. Cl.

CPC ............ *A61K 47/6829* (2017.08); *A61K 8/99* (2013.01); *A61K 38/164* (2013.01); *C07K 14/195* (2013.01); *C07K 14/25* (2013.01); *A61K 2039/6037* (2013.01); *C07K 2319/05* (2013.01); *C07K 2319/55* (2013.01)

(58) Field of Classification Search

None

See application file for complete search history.

(56) References Cited

U.S. PATENT DOCUMENTS

| | | | |
|---|---|---|---|
| 5,080,898 | A | 1/1992 | Murphy |
| 5,135,736 | A | 8/1992 | Anderson et al. |
| 5,552,144 | A | 9/1996 | Samuel et al. |
| 5,635,384 | A | 6/1997 | Walsh et al. |
| 5,668,255 | A | 9/1997 | Murphy |
| 5,858,682 | A | 1/1999 | Gruenwald et al. |
| 6,022,950 | A | 2/2000 | Murphy |
| 6,080,400 | A | 6/2000 | Williams et al. |
| 6,492,498 | B1 | 12/2002 | Vallera et al. |
| 6,652,857 | B2 | 11/2003 | Williams et al. |
| 6,770,456 | B1 | 8/2004 | Coulie et al. |
| 7,144,991 | B2 | 12/2006 | Goshom et al. |
| 7,267,973 | B2 | 9/2007 | Backer et al. |
| 7,527,787 | B2 | 5/2009 | Chang et al. |
| 7,700,557 | B2 | 4/2010 | Backer et al. |
| 7,713,915 | B1 | 5/2010 | Gariepy et al. |
| 7,799,900 | B2 | 9/2010 | Adams |
| 7,834,258 | B2 | 11/2010 | Choe et al. |
| 7,887,801 | B2 | 2/2011 | Wels et al. |
| 8,048,985 | B2 | 11/2011 | Harrison et al. |
| 8,147,832 | B2 | 4/2012 | Carr et al. |
| 8,337,844 | B2 | 12/2012 | Carr et al. |
| 8,470,314 | B2 | 6/2013 | Davis et al. |
| 8,530,637 | B2 | 9/2013 | Wels et al. |
| 8,865,866 | B2 | 10/2014 | Harrison et al. |
| 8,895,006 | B2 | 11/2014 | Tumer et al. |
| 8,969,529 | B2 | 3/2015 | O'Brien et al. |

(Continued)

FOREIGN PATENT DOCUMENTS

| | | | |
|---|---|---|---|
| AU | 750367 | B2 | 7/2002 |
| CN | 1272882 | A | 11/2000 |

(Continued)

OTHER PUBLICATIONS https://www.genome.gov/genetics-glossary/antisense; retrieved on Jul. 17, 2021, 2 pages.

Muzard, J. et al., "Grafting of protein L-binding activity onto recombinant antibody fragments," Analytical Biochemistry, 388(2):331-338 (2009).

Nilson, B. H. K. et al., "Protein L from Peptostreptococcus magnus binds to the kappa light chain variable domain," Journal of Biological Chemistry, 267(4):2234-2239 (1992).

(Continued)

*Primary Examiner* — Sarvamangala Devi

(74) *Attorney, Agent, or Firm* — Cooley LLP

(57) ABSTRACT

The present invention provides Shiga toxin A Subunit derived polypeptides, scaffolds, and cell-targeting molecules comprising amino acid substitutions which equip the molecules with site-specific positions (and often unique amino acid residues in the molecule) for linking other molecules while retaining Shiga toxin function(s), such as, e.g., efficient intracellular routing and/or potent cytotoxicity. The present invention also provides cell-targeting molecules, and/or components thereof, which comprise site-specific positions for linking other molecules, such as, e.g., agents that alters a property of the cell-targeting molecule or a cargo for delivery. Certain molecules comprising a polypeptide of the present invention exhibit reduced immunogenicity and/or are well-tolerated by mammals. The cell-targeting molecules of the present invention, and compositions thereof, have uses, e.g., for the selective delivery of cargos to target-expressing cells and as diagnostic and/or therapeutic molecules for the treatment of a variety of diseases, disorders, and conditions, which include genetic disorders, genetic predispositions, infections, cancers, tumors, growth abnormalities, and/or immune disorders.

10 Claims, 19 Drawing Sheets

Specification includes a Sequence Listing.

(56) References Cited

U.S. PATENT DOCUMENTS

| | | | |
|---|---|---|---|
| 9,175,059 B2 | 11/2015 | Pieczykolan et al. | |
| 9,364,557 B2 | 6/2016 | Neville, Jr. et al. | |
| 10,421,958 B2 | 9/2019 | Poma et al. | |
| 10,815,469 B2 | 10/2020 | Poma et al. | |
| 11,136,395 B2 | 10/2021 | Poma et al. | |
| 11,225,509 B2 * | 1/2022 | Poma | C12Y 204/02036 |
| 2002/0012658 A1 | 1/2002 | Williams et al. | |
| 2002/0168370 A1 | 11/2002 | McDonald, Jr. et al. | |
| 2003/0166196 A1 | 9/2003 | Better et al. | |
| 2004/0141982 A1 | 7/2004 | Lust et al. | |
| 2004/0166565 A1 | 8/2004 | Backer et al. | |
| 2005/0054835 A1 | 3/2005 | Better et al. | |
| 2005/0069545 A1 | 3/2005 | Carr et al. | |
| 2009/0023649 A1 | 1/2009 | Backer et al. | |
| 2009/0092578 A1 | 4/2009 | Su et al. | |
| 2009/0156417 A1 | 6/2009 | Gariepy et al. | |
| 2009/0156502 A1 | 6/2009 | Harrison et al. | |
| 2010/0093563 A1 | 4/2010 | Williamson et al. | |
| 2010/0285004 A1 | 11/2010 | Tesar et al. | |
| 2011/0189209 A1 | 8/2011 | Neville, Jr. et al. | |
| 2012/0039908 A1 | 2/2012 | Combs et al. | |
| 2012/0149650 A1 | 6/2012 | Harrison et al. | |
| 2012/0251542 A1 | 10/2012 | Turner et al. | |
| 2012/0258104 A1 | 10/2012 | Echeverri | |
| 2013/0071325 A1 | 3/2013 | Sahin et al. | |
| 2013/0189271 A1 | 7/2013 | De Goeij et al. | |
| 2013/0196928 A1 | 8/2013 | Gariepy et al. | |
| 2014/0030273 A1 | 1/2014 | Verploegen et al. | |
| 2015/0044210 A1 | 2/2015 | Mechaly et al. | |
| 2015/0259428 A1 | 9/2015 | Poma et al. | |
| 2016/0017047 A1 | 1/2016 | Poma et al. | |
| 2016/0017784 A1 | 1/2016 | Kumar | |
| 2016/0068577 A1 | 1/2016 | Poma et al. | |
| 2016/0130362 A1 | 5/2016 | de Weers | |
| 2016/0177284 A1 | 6/2016 | Poma et al. | |
| 2016/0340394 A1 | 11/2016 | Poma et al. | |
| 2016/0347798 A1 | 12/2016 | Poma et al. | |
| 2016/0355803 A1 | 12/2016 | Poma et al. | |
| 2016/0376328 A1 | 12/2016 | Poma et al. | |
| 2017/0002046 A1 | 1/2017 | Shishido et al. | |
| 2017/0101636 A1 | 4/2017 | Poma et al. | |
| 2017/0143814 A1 | 5/2017 | Poma et al. | |
| 2017/0275382 A1 | 9/2017 | Poma et al. | |
| 2018/0057544 A1 | 3/2018 | Poma et al. | |
| 2018/0243432 A1 | 8/2018 | Poma et al. | |
| 2018/0258143 A1 | 9/2018 | Poma et al. | |
| 2018/0258144 A1 | 9/2018 | Poma et al. | |
| 2018/0291359 A1 | 10/2018 | Poma et al. | |
| 2019/0083644 A1 | 3/2019 | Yoo et al. | |
| 2019/0100597 A1 | 4/2019 | Keyt et al. | |
| 2019/0153044 A1 | 5/2019 | Poma et al. | |
| 2019/0153471 A1 | 5/2019 | Paul et al. | |
| 2019/0249145 A1 | 8/2019 | Jang et al. | |
| 2019/0382755 A1 | 12/2019 | Poma et al. | |
| 2020/0002387 A1 | 1/2020 | Poma et al. | |
| 2020/0024312 A1 | 1/2020 | Poma et al. | |
| 2021/0008208 A1 | 1/2021 | Poma et al. | |
| 2021/0017512 A1 | 1/2021 | Poma et al. | |
| 2021/0253648 A1 | 8/2021 | Poma et al. | |
| 2021/0253649 A1 | 8/2021 | Poma et al. | |
| 2021/0268085 A1 | 9/2021 | Poma et al. | |

FOREIGN PATENT DOCUMENTS

| | | | |
|---|---|---|---|
| CN | 105713087 | A | 6/2016 |
| EP | 1 654 287 | A2 | 8/2010 |
| EP | 2 778 173 | A1 | 9/2014 |
| EP | 3 265 575 | A2 | 1/2018 |
| EP | 3 448 874 | A1 | 3/2019 |
| GB | 2 519 786 | A | 5/2015 |
| JP | 1993-502880 | A | 5/1993 |
| JP | 2001-500730 | A | 1/2001 |
| JP | 2002-521019 | A | 7/2002 |
| JP | 2002-544173 | A | 12/2002 |
| JP | 2003-531588 | A | 10/2003 |
| JP | 2004-536778 | A | 12/2004 |
| JP | 2006-502699 | A | 1/2006 |
| JP | 2006-513691 | A | 4/2006 |
| JP | 2007-536905 | A | 12/2007 |
| JP | 2008-533977 | A | 8/2008 |
| JP | 2009-502936 | A | 1/2009 |
| JP | 2009-530468 | A | 8/2009 |
| JP | 2011-050388 | A | 3/2011 |
| JP | 2011-507389 | A | 3/2011 |
| JP | 2012-044997 | A | 3/2012 |
| JP | 2012-070737 | A | 4/2012 |
| JP | 2012-515551 | A | 7/2012 |
| JP | 2012-533587 | A | 12/2012 |
| JP | 2014-515921 | A | 7/2014 |
| KR | 2011-0033233 | A | 3/2011 |
| KR | 2011-0119725 | A | 11/2011 |
| WO | WO 91/009871 | A1 | 7/1991 |
| WO | WO 94/26910 | A1 | 11/1994 |
| WO | WO 96/30043 | A1 | 10/1996 |
| WO | WO 96/040200 | A1 | 12/1996 |
| WO | WO 98/11229 | A3 | 3/1998 |
| WO | WO 99/40185 | A1 | 8/1999 |
| WO | WO 00/04926 | A2 | 2/2000 |
| WO | WO 00/67795 | A1 | 11/2000 |
| WO | WO 01/70945 | A1 | 9/2001 |
| WO | WO 01/77342 | A1 | 10/2001 |
| WO | WO 02/40506 | A2 | 5/2002 |
| WO | WO 03/066854 | A1 | 8/2003 |
| WO | WO 03/072746 | A2 | 9/2003 |
| WO | WO 03/074567 | A2 | 9/2003 |
| WO | WO 2004/056312 | A2 | 7/2004 |
| WO | WO 2004/058158 | A2 | 7/2004 |
| WO | WO 2005/000902 | A1 | 1/2005 |
| WO | WO 2005/016969 | A2 | 2/2005 |
| WO | WO 2005/017148 | A1 | 2/2005 |
| WO | WO 2005/052006 | A2 | 6/2005 |
| WO | WO 2005/052129 | A2 | 6/2005 |
| WO | WO 2005/092917 | A1 | 10/2005 |
| WO | WO 2006/099875 | A1 | 9/2006 |
| WO | WO 2007/005874 | A2 | 1/2007 |
| WO | WO 2007/014238 | A2 | 2/2007 |
| WO | WO 2007/033497 | A1 | 3/2007 |
| WO | WO 2007/071061 | A1 | 6/2007 |
| WO | WO 2007/098201 | A2 | 8/2007 |
| WO | WO 2007/107779 | A1 | 9/2007 |
| WO | WO 2008/080218 | A1 | 7/2008 |
| WO | WO 2009/014835 | A2 | 1/2009 |
| WO | WO 2009/017823 | A2 | 2/2009 |
| WO | WO 2009/032954 | A1 | 3/2009 |
| WO | WO 2009/064815 | A1 | 5/2009 |
| WO | WO 2009/088403 | A2 | 7/2009 |
| WO | WO 2009/110944 | A1 | 9/2009 |
| WO | WO 2010/011697 | A1 | 1/2010 |
| WO | WO 2010/085539 | A1 | 7/2010 |
| WO | WO 2011/009624 | A1 | 1/2011 |
| WO | WO 2012/022985 | A1 | 2/2012 |
| WO | WO 2012/093158 | A1 | 7/2012 |
| WO | WO 2012/101235 | A1 | 8/2012 |
| WO | WO 2012/104344 | A1 | 8/2012 |
| WO | WO 2012/154530 | A1 | 11/2012 |
| WO | WO 2013/080147 | A2 | 6/2013 |
| WO | WO 2014/086952 | A1 | 6/2014 |
| WO | WO 2014/164680 | A1 | 10/2014 |
| WO | WO 2014/164693 | A2 | 10/2014 |
| WO | WO 2015/063187 | A1 | 5/2015 |
| WO | WO 2015/113005 | A1 | 7/2015 |
| WO | WO 2015/113007 | A1 | 7/2015 |
| WO | WO 2015/120058 | A2 | 8/2015 |
| WO | WO 2015/138435 | A1 | 9/2015 |
| WO | WO 2015/138452 | A1 | 9/2015 |
| WO | WO 2015/191764 | A1 | 12/2015 |
| WO | WO 2015/191883 | A1 | 12/2015 |
| WO | WO 2015/193411 | A1 | 12/2015 |
| WO | WO 2016/126950 | A1 | 8/2016 |
| WO | WO 2016/196344 | A1 | 12/2016 |
| WO | WO 2017/019623 | A2 | 2/2017 |
| WO | WO 2018/080812 | A1 | 5/2018 |
| WO | WO 2018/106895 | A1 | 6/2018 |
| WO | WO 2018/140427 | A1 | 8/2018 |

(56) References Cited

FOREIGN PATENT DOCUMENTS

WO WO 2018/159615 A1 9/2018
WO WO 2018/162749 A1 9/2018
WO WO 2019/059400 A1 3/2019
WO WO 2020/081493 A1 4/2020
WO WO 2020/154475 A1 7/2020

OTHER PUBLICATIONS

Nilson, B. H. K. et al., "Purification of antibodies using protein L-binding framework structures in the light chain variable domain," Journal of Immunological Methods, 164(1):33-40 (1993).

Amino Acids; https://www.promega.com/-/media/files/resources/technical-references/amino-acid-abbreviations-and-molecular-weights.pdf; retrieved on Feb. 26, 2018, 1 page.

UniProtKB/Swiss-Prot P09385 (STXA_BP933), Shiga-like toxin 2 subunit A, retrieved from https://www.ncbi.nlm.nih.gov/protein/P09385.2 on Jan. 10, 2018, 7 pages.

Aatsinki, J. T. et al., "An alternative use of basic pGEX vectors for producing both N- and C-terminal fusion proteins for production and affinity purification of antibodies," Protein Expression and Purification, 40(2):287-291 (2005).

Ackerman, R. et al., "SLT-VEGF Reduces Lung Metastases, Decreases Tumor Recurrence, and Improves Survival in an Orthotropic Melanoma Model," Toxins (Basel), 2(9):224-257 (2010).

Adotevi, O. et al., "B Subunit of Shiga Toxin-Based Vaccines Synergize with α-Galactosylceramide to Break Tolerance against Self Antigen and Elicit Antiviral Immunity," The Journal of Immunology, 179(5):3371-3379 (2007).

Al-Jaufy, A. Y. et al., "Cytotoxicity of a Shiga toxin A Subunit-CD4 Fusion Protein to Human Immunodeficiency Virus-Infected Cells," Infection and Immunity, 62(3):956-960 (1994).

Al-Jaufy, A. Y. et al., "Purification and Characterization of a Shiga-Toxin A Subunit-CD4 Fusion Protein Cytotoxic to Human Immunodeficiency Virus-Infected Cells," Infection and Immunity, 63(8):3073-3078 (1995).

Antignani, A. & Fitzgerald, D., "Immunotoxins: The Role of the Toxin," Toxins, 5(8):1486-1502 (2013).

Apostolpoulos, V. et al., "MUC1 peptide epitopes associated with five different H-2 class I molecules," European Journal of Immunology, 27(10):2579-2587 (1997).

Backer, M. V. et al., "Shiga-like toxin-VEGF fusion proteins are selectively cytotoxic to endothelial cells overexpressing VEGFR-2," Journal of Controlled Release, 74(1-3):349-355 (2001).

Backer, M. V. & Backer, J. M., "Targeting Endothelial Cells Overexpressing VEGFR-2: Selective Toxicity of Shiga-like Toxin-VEGF Fusion Proteins," Bioconjugate Chemistry, 12(6):1066-1073 (2001).

Baker, M. P. et al., "Immunogenicity of Protein Therapeutics: the Key Causes, Consequences and Challenges," Self/Nonself, 1(4):314-322 (2010).

Ballard, J. D. et al., "Anthrax Toxin-Mediated Delivery In Vivo and In Vitro of a Cytotoxic T-Lymphocyte Epitope from Ovalbumin," Infection and Immunity, 66(2):615-619 (1998).

Ballard, J. D. et al., "Anthrax Toxin as a Molecular Tool for Stimulation of Cytotoxic T Lymphocytes: Disulfide-Linked Epitopes, Multiple Injections, and Role of CD4+ Cells," Infection and Immunity, 66(10):4696-4699 (1998).

Barnd, D. L. et al., "Specific, Major Histocompatibility Complex-Unrestricted Recognition of Tumor-Associated Mucins by Human Cytotoxic T cells," Proceedings of the National Academy of Sciences U.S.A., 86(18):7159-7163 (1989).

Barratt-Boyes, S. M. et al., "Immunization of Chimpanzees with Tumor Antigen MUC1 Mucin Tandem Repeat Peptide Elicits Both Helper and Cytotoxic T-cell Responses," Clinical Cancer Research, 5(7):1918-1924 (1999).

Beers, S. A. et al., "Type II (tositumomab) anti-CD20 monoclonal antibody out performs type I (rituximab-like) reagents in B-cell depletion regardless of complement activation," Blood, 112:4170-4177 (2008).

Beers, S. A. et al., "CD20 as A Target for Therapeutic type I and II Monoclonal Antibodies," Seminars in Hematology, 47(2):107-114 (2010).

Beers, S. A. et al., "Antigenic modulation limits the efficacy of anti-CD20 antibodies: implications for antibody selection," Blood, 1115(25):5191-5201 (2010).

Bera, T. K. et al., "A Bivalent Disulfide-stabilized Fv with Improved Antigen Binding to erbB2," Journal of Molecular Biology, 281(3):475-483 (1998).

Bera, T. K. et al., "Pharmacokinetics and Antitumor Activity of a Bivalent Disulfide-stabilized Fv Immunotoxin with Improved Antigen Binding to erbB2," Cancer Research, 59(16):4018-4022 (1999).

Beum, P. V. et al., "The Shaving Reaction: Rituximab/CD20 Complexes are Removed from Mantle Cell Lymphoma and Chronic Lymphocytic Leukemia Cells by THP-1 Monocytes," The Journal of Immunology, 176(4):2600-2609 (2006).

Beum, P. V. et al., "Loss of CD20 and Bound CD20 Antibody from Opsonized B Cells Occurs More Rapidly Because of Trogocytosis Mediated by Fc Receptor-Expressing Effector Cells than Direct Internalization by the B Cells," The Journal of Immunology, 187(6):3438-3447 (2011).

Bevan et al. "Real-time 96-well antibody internalization assays using IncuCyte FabFlour Red Antibody Labeling Reagent, Application Note, Sartorious", Essen BioScience (2017).

Bibby, M. C., "Orthotopic models of cancer for preclinical drug evaluation: advantages and disadvantages," European Journal of Cancer, 40(6):852-857 (2004).

Boes, A. et al., "Affinity Purification of a Framework 1 Engineered Mouse/Human Chimeric IgA2 Antibody From Tobacco," Biotechnology Bioengineering, 108(12):2804-2814 (2011).

Boldicke, T., "Blocking translocation of cell surface molecules from the ER to the cell surface by intracellular antibodies targeted to the ER," J. Cell. Mol., 11(1):54-70 (2007).

Bolognesi, A. et al., "A comparison of anti-lymphocyte immunotoxins containing different ribosomeinactivating proteins and antibodies," Clinical & Experimental Immunology, 89(3):341-346 (1992).

Bonifaz, L. et al., "Efficient targeting of protein antigen to the dendritic cell receptor DEC-205 in the steady state leads to antigen presentation on major histocompatibility complex class I products and peripheral CD8+ T cell tolerance," Journal of Experimental Medicine, 196(12):1627-1638 (2002).

Boross, P. et al., "Both activating and inhibitory Fc gamma receptors mediate rituximab-induced trogocytosis of CD20 in mice," Immunology Letters, 143(1):44-52 (2012).

Boross, P. et al., "Mechanisms of action of CD20 antibodies," American Journal of Cancer Research, 2(6):676-690 (2012).

Braslawsky, G. R. et al., "Adriamycin(hydrazone)-antibody conjugates require internalization and intracellular acid hydrolysis for antitumor activity," Cancer Immunology, Immunotherapy, 33:367-374 (1991).

Bray, M. R. et al., "Probing the surface of eukaryotic cells using combinatorial toxin libraries," Current Biology, 11(9):697-701 (2001).

Brieschke, B. et al., "Targeted Engineered Toxin Bodies provide a novel mechanism of action against HER2 positive cancers," Cancer Research, 78 (13 Suppl), (Jul. 2018), Abstract 5769.

Brieschke, B. et al., "Targeted Engineered Toxin Bodies provide a novel mechanism of action against HER2 positive cancers," Proceedings: American Association for Cancer Research (AACR) Annual Meeting 2018, (Apr. 18, 2018).

Brieschke, B. et al., "Identification and Functional Profiling of PD-L1 Targeted Engineered Toxin Bodies for Antigen Seeding Technology (AST) and Redirection of T cell Response to Tumors," 33rd Annual Meeting of the Society for Immunotherapy of Cancer (SITC), Washington, D.C., Poster # 11078, (Nov. 7-11, 2018).

Brieschke, B. et al., "Identification and functional profiling of PD-L1 targeted engineered toxin bodies for antigen seeding technology and redirection of T cell response to tumors," Journal of ImmunoTherapy of Cancer, 6(Suppl 1): 114, (Nov. 6, 2018), Abstract P9.

Brieschke, B. et al., "Identification and functional profiling of PD-L1 targeted engineered toxin bodies for antigen seeding technology and redirection of T cell response to tumors," Journal for Immunotherapy of Cancer, 6(S1):p. 5 (2018).

(56) References Cited

OTHER PUBLICATIONS

Brieschke, B. et al., "Antigen Seeding Technology by engineered Toxin bodies Provides a Targeted Immuno-Oncology Approach for Treatment of Cancers," Proceedings: American Association for Cancer Research (AACR) Annual Meeting 2018, Poster 2777, Abstract #4912 (Apr. 14-18, 2018).
Brigotti, M. et al., "Damage to Nuclear DNA Induced by Shiga Toxin 1 and Ricin in Human Endothelial Cells," The FASEB Journal, 16(3):365-372 (2002).
Brigotti, M. et al., "Change in Conformation with Reduction of a-Helix Content Causes Loss of Neutrophil Binding Activity in Fully Cytotoxic Shiga toxin 1," The Journal of Biological Chemistry, 286(40):34514-34521 (2011).
Bujny, M. V. et al., "The retromer component sorting nexin-1 is required for efficient retrograde transport of Shiga toxin from early endosome to the trans Golgi network," Journal of Cell Science, 120(Pt 12):2010-2021 (2007).
Burgess, B. J. et al., "Proteolytic cleavage at arginine residues within the hydrophilic disulphide loop of the *Escherichia coli* Shiga-like toxin I A subunit is not essential for cytotoxicity," Molecular Microbiology, 10(1):171-179 (1993).
Cao, C. et al., "Construction of mutant genes for a non-toxic verotoxin 2 variant (VT2vp1) of *Escherichia coli* and characterization of purified mutant toxins," Microbiology and Immunology, 38(6):441-447 (1994).
Cao, Y. et al., "Design optimization and characterization of Her2/neu-targeted immunotoxins: comparative in vitro and in vivo efficacy studies," Oncogene, 33(4):1-11 (2013).
Cao, Y. et al., "Construction and characterization of novel, recombinant immunotoxins targeting the Her2/neu oncogene product: in vitro and in vivo studies," Cancer Research, 69(23): 8987-8995 (2009).
Carbonetti, N. H. et al., "Intracellular Delivery of a Cytolytic T-Lymphocyte Epitope Peptide by Pertussis Toxin to Major Histocompatibility Complex Class I without Involvement of the Cytosolic Class I Antigen Processing Pathway," Infection and Immunity, 67(2):602-607 (1999).
Carbonetti, N. H. et al., "Stimulation of HIV gp120-specific cytolytic T lymphocyte responses in vitro and in vivo using a detoxified pertussis toxin vector," AIDS Research and Human Retroviruses, 17(9): 819-827 (2001).
Carbonetti, N. H., "Pertussis toxin and adenylate cyclase toxin: key virulence factors of Bordetella pertussis and cell biology tools," Future Microbiology, 5:455-469 (2010).
Casalini, P. et al., "Use of combination of Monoclonal Antibodies Directed Against three distinct epitopes of a Tumor-Associated Antigen: Analysis of Cell-Binding and Internalization," International Journal of Cancer, 48:2 284-290 (1991).
Gasset, F. et al., "A peptide mimetic of an anti-CD4 monoclonal antibody by rational design," Biochemical and Biophysical Research Communications, 307(1):198-205 (2003).
Chatterjee, S. et al., "Noninvasive Imaging of Immune Checkpoint Ligand PD-L1 in Tumors and Metastases for Guiding Immunotherapy," Molecular Imaging, 16:1-5 (2017).
Cheung, M. C. et al., "An evolved ribo-inactivating protein targets and kills human melanoma cells in vitro and in vivo," Molecular Cancer, 9(28):1-14 (2010).
Cheung, M. C. et al., "A Ribosome-inactivating Protein Toxin as a Template for Cancer Drug Discovery", thesis, University of Toronto, (2012), retrieved from http://hdl.handle.net/1807/33952, 202 pages.
Cizeau, J. P. A. et al., "DeBouganin: A de-immunized toxin payload and its applications in oncology," 8th Fabisch-Symposium, 3rd Targeted Tumor Therapies, Berlin 2012, Mar. 21, 2012.
Cizeau, J. et al., "Fusogenics: A Recombinant Immunotoxin-Based Screening Platform to Select Internalizing Tumor-Specific Antibody Fragments," Journal of Biomolecular Screening 16(1):90-100 (2011).
Cleton-Jansen, A. et al., "A Single Amino Acid Substitution Changes the Substrate Specificity of Quinoprotein Glucose Dehydrogenase in Gluconobacter oxydans," Molecular and General Genetics, 229(2):206-212 (1991).
Cragg, M. S. et al., "Apparent modulation of CD20 by rituximab: an alternative explanation," Blood, 103(10):3889-3990 (2004).
Cuesta, A. M.. et al., "Mutivalent antibodies: when design surpasses evolution," Trends in Biotechnology, 28(7):355-362 (2010).
Dadaglio, G, et al., "Induction of a Polarized Th1 Response by Insertion of Multiple Copies of a Viral T-Cell Epitope into Adenylate Cyclase of Bordetella pertussis," Infection and Immunity, 68(7):3867-3872 (2000).
Dadaglio, G, et al., "Recombinant adenylate cyclase toxin of Bordetella pertussis induces cytotoxic T lymphocyte responses against HLA*0201-restricted melanoma epitopes," International Immunology, 15(12):1423-1430 (2003).
De Pascalis, R. et al., "Grafting of "abbreviated" complementarity-determining regions containing specificity-determining residues essential for ligand contact to engineer a less immunogenic humanized monoclonal antibody," The Journal of Immunology, 169(6):3076-3084 (2002).
Dekker et al., "Engineered Toxin Bodies delivering immunogenic MHC class I peptides to tumor cells summon polyfunctional and relevant CTL responses against cancers," Presented at: Immunology 2019™, Annual Meeting of the American Association of Immunologists, May 10, 2019, The American Association of Immunologists, Inc., San Diego, Abstract 1791.
Dekker, J. D. et al., Abstract 1791, "Engineered toxin bodies delivering immunogenic MHO class I peptides to tumor cells summon polyfunctional and relevant CTL responses against cancers," Molecular Templates, AAI 2019, Poster, 2 pages.
Deresiewicz, R. L. et al., "Mutations Affecting the Activity of the Shiga-like Toxin I A-Chain," Biochemistry, 31(12):3272-3280 (1992).
Deresiewicz, R. L. et al., "The role of tyrosine-114 in the enzymatic activity of the Shiga-like toxin I A-chain," Mol. Gen. Genet, 241:467-473 (1993).
Deret, S. et al., "SUBIM: a program for analysing the Kabat database and determining the variability subgroup of a new immunoglobulin sequence," CABIOS, 11 (4):435-439 (1995).
Dermer, G. B., "Another Anniversary for the War on Cancer," Bio/Technology 12:320 (1994).
Di, R. et al., "Identification of amino acids critical for the cytotoxicity of Shiga toxin 1 and 2 in *Saccharomyces cerevisiae*," Toxicon, 57(4):525-539 (2011).
Doling, A. M. et al., "Cytotoxic T-Lymphocyte Epitopes Fused to Anthrax toxin Induce protective Antiviral Immunity," Infection and Immunity, 67(7):3290-3296 (1999).
Donnelly, J. J. et al., "Targeted delivery of peptide epitopes to class I major histocompatibility molecules by a modified Pseudomonas exotoxin," Proceedings of the National Academy of Sciences U.S. A., 90:3530-3534 (1993).
Edelman, G. M. & Gally, J. A., "Degeneracy and complexity in biological systems," PNAS, 98(24):13763-13768 (2001).
Engedal, N. et al., "Shiga toxin and its use in targeted cancer therapy and imaging," Microbiology Biotechnology, 4(1):32-46 (2011).
Eriksson, K. et al., "Coupling of antigen to cholera toxin for dendritic cell vaccination promotes the induction of MHC class I-restricted cytotoxic T cells and the rejection of a cognate antigen-expressing model tumor," European Journal of Immunology, 34(5):1272-1281 (2004).
Ewers, H. & Helenius, A., "Lipid-Mediated Endocytosis," Cold Spring Harbor Perspectives in Biology, 3(8):1-14 (2011).
Fanale, M. A. et al., "Phase I/Ib study of the novel CD20-targeted immunotoxin MT-3724 in relapsed/refractory non-Hodgkin's B-cell lymphoma," Proceedings of the 107th Annual Meeting of the American Association for Cancer Research (AACR), Abstract # CT049, (Apr. 16-20, 2016), 2 pages.
Fanale, M. A. et al., "Phase I/Ib study of the novel CD20-targeted immunotoxin MT-3724 in relapsed/refractory non-Hodgkin's B-cell lymphoma," Cancer Research, 76(14 Suppl), (Jul. 2016), Abstract nr CT049.
Fayolle, C. et al., "Delivery of Multiple Epitopes by Recombinant Detoxified Adenylate Cyclase of Bordetella pertussis Induces Protective Antiviral Immunity," Journal of Virology, 75(16):7330-7338 (2001).

(56) References Cited

OTHER PUBLICATIONS

Fayolle, C, et al., "Therapy of Murine Tumors with Recombinant Bordetella pertussis Adenylate Cyclase Carrying a Cytotoxic T Cell Epitope," The Journal of Immunology, 162(7): 4157-4162 (1999).
Filpula, D., "Releasable PEGylation of Mesothelin Targeted Immunotoxin SSIP Achieves Single Dosage Complete Regression of a Human Carcinoma in Mice," Bioconjugate Chemistry, 18(3):773-784 (2007).
Freshney, R.I., "Culture of Animal Cells: A Manual of Basic Technique," Alan R. Liss, Inc., 1983, New York, pp. 3-4.
Gannon, V. P. et al., "Molecular cloning and nucleotide sequence of another variant of the *Escherichia coli* Shiga-like toxin II family," Journal of General Microbiology, 136(6):1125-1135 (1990).
Garred, O. et al., "Role of processing and intracellular transport for optimal toxicity of Shiga toxin and toxin mutants," Experimental Cell Research, 218(1):39-49 (1995).
Garred, O. et al., "Furin-induced cleavage and activation of Shiga toxin," Journal of Biological Chemistry, 270(18): 10817-10821 (1995).
Gavrilov, B. K. et al., "Effects of Glycosylation on Antigenicity and Immunogenicity of Classical Swine Fever Virus Envelope Proteins," Virology, 420(2):135-145 (2011).
Gendler, S. et al., "A Highly Immunogenic Region of a Human Polymorphic Epithelial Mucin Expressed by Carcinomas is Made Up of Tandem Repeats," Journal of Biological Chemistry, 263(26):12820-12823 (1988).
Ghetie, M. A. et al., "Homodimers but not monomers of Rituxan (chimeric anti-CD20) induce apoptosis in human B-lymphoma cells and synergize with a chemotherapeutic agent and an immunotoxin," Blood, 97(5):1392-1398 (2001).
Giansanti, F. et al., "Strategies to Improve the Clinical Utility of Saporin-Based Targeted Toxins," Toxins, 10(82):1-32 (2018).
Gielis, S. et al., "Detection of Enriched T Cell Epitope Specificity in Full T Cell Receptor Sequence Repertoires," Frontiers in Immunology, vol. 10, Article 2820, pp. 1-13 (2019).
Gilliland, D. G. et al., "Antibody-directed cytotoxic agents: use of monoclonal antibody to direct the action of toxin A chains to colorectal carcinoma cells," Proceedings of the National Academy of Sciences of the United States of America, 77(8):4539-43 (1980).
Glennie, M. J. et al., "Mechanisms of killing by anti-CD20 monoclonal antibodies," Molecular Immunology, 44(16):3823-3837 (2007).
Gong, J. et al., "Selection and characterization of MUC1-specific CD8+ T cells from MUC1 transgenic mice immunized with dendritic-carcinoma fusion cells," Immunology, 101(3):316-324 (2000).
Gordon, V. M. et al., "An enzymatic Mutant of Shiga-like Toxin II Variant is a vaccine Candidate for Edema Disease of Swine," Infection and Immunity, 60(2):485-490 (1992).
Goulet, A. O. et al. ."Conjugation of Blocked Ricin to an Anti-CD 19 Monoclonal Antibody Increases Antibody-Induced cell Calcium Mobilization and CD19 Internalization," Blood 90(6): 2364-2375 (1995).
Grant, K. et al., "Abstract 1380: Engineered toxin bodies with specific activity against EGFR and HER2 expressing cells," Proceedings of the 102nd Annual Meeting of the American Association for Cancer Research (AACR); Apr. 2-6, 2011; The Journal of Cancer Research, 71 (8 Suppl): Abstract #1380, (Apr. 2011).
Grotzke, J. E. et al., "The ongoing saga of the mechanism(s) of MHC class I-restricted crosspresentation," Current Opinion in Immunology, 46:89-96 (2017).
Guermonprez, P. et al., "Les Toxines Bacteriennes Recombinantes: De Nouveaux Vecteurs Pour La Vaccination?" M/S Medicine Sciences, Societe Des Periodiques Flammarion, 16(5):653-662 (2000).
Guermonprez, P. et al., "The Adenylate Cyclase Toxin of *Bordetella pertussis* Binds to Target Cells via the αMβ2 Integrin (CD11 b/CD18)," Journal of Experimental Medicine, 193(9):1035-1044 (2001).
Güssow, D. & Seeman, G., "Humanization of Monoclonal Antibodies," Methods in Enzymology, 203:99-121 (1991).
Haddad, J. E. et al., "Minimum Domain of the Shiga Toxin A subunit Required for Enzymatic Activity," Journal of Bacteriology, 175(16):4970-4978 (1993).
Haicheur, N. et al., "The B Subunit of Shiga Toxin Fused to a Tumor Antigen Elicits CTL and Targets Dendritic Cells to Allow MHC Class I-Restricted Presentation of Peptides Derived from Exogenous Antigens," The Journal of Immunology, 165(6):3301-3308 (2000).
Haisma, H. J. et al., "Construction and Characterization of a Fusion Protein Single-Chain Anti-CD20 Antibody and Human beta-glucuronidase for Antibody-Directed Enzyme Prodrug Therapy," Blood, 92(1):184-190 (1998).
Hamlin, P. A. et al., "Safety and Efficacy of Anti-CD20 Immunotoxin MT-3724 in Relapsed/refractory B-cell Non-Hodgkin Lymphoma (NHL) in a Phase 1 study," American Society of Clinical Oncology Annual Meeting—Abstract 7580 (2018).
Harris, B., "Exploiting antibody-based technologies to manage environmental pollution," Trends in Biotechnology, DIAGRAM figure taken from 17(7):290-296 (1999).
Harwerth, I. M et al., "Monoclonal Antibodies against the Extracellular Domain of the erbB-2 Receptor Function as Partial Ligand Agonists," Journal of Biol. Chem, 267(21):15160-15167 (1992).
Head, S. C. et al., "Preparation of VT1 and VT2 hybrid toxins from their purified dissociated subunits. Evidence for B subunit modulation of a subunit function," Journal of Biological Chemistry, 266(6):3617-3621 (1991).
Hegde, N. R. et al., "The use of databases, data mining and immunoinformatics in vaccinology: where are we?" Expert Opinion on Drug Discovery, 13(2):117-130 (2018).
Hexham, J. M. et al., "Influence of relative binding affinity on efficacy in a panel of anti-CD3 scFv immunotoxins," Molecular Immunology, 38(5):397-408 (2001).
Higgins, J. P. et al., "Engineered toxin bodies with specific cell kill activity against mesenchymal cells," Cancer Research, 71(8 Suppl) (Apr. 2011), Abstract #1751.
Hiraga, . et al., "Down-regulation of CD20 expression in B-cell lymphoma cells after treatment with rituximab-containing combination chemotherapies: its prevalence and clinical significance," Blood, 113(20):4885-4893 (2009).
Holubova, J. et al., "Delivery of Large Heterologous Polypeptides across the Cytoplasmic Membrane of Antigen-Presenting Cells by the Bordetella RTX Hemolysin Moiety Lacking the Adenylyl Cyclase Domain," Infection and Immunity, 80(3):1181-1192 (2012).
Hooijberg et al., "Characterization of a series of isotype switch variants of new CD20 monoclonal antibody," Hybridoma, 15(1):23-31 (1996).
Hotz, B. et al., "Specific Targeting of Tumor Endothelial Cells by a Shiga-like Toxin-Vascular Endothelial Growth Factor Fusion Protein as a Novel Treatment Strategy for Pancreatic Cancer," Neoplasia, 12(10):797-806 (2010).
Hovde, C. J. et al.,"Evidence that glutamic acid 167 is an active-site residue of Shiga-like toxin-I," Proceedings of the National Academy of Sciences of the United States of America, 85(8):2568-2572 (1988).
Huang, S. et al., "The CD20-specific engineered toxin antibody MT-3724 exhibits lethal effects against mantle cell lymphoma," Blood Cancer Journal, 8(3):33 (2018).
Huang, S. et al. "Abstract 3651: Preclinical examination of the effects of MT-3724, an engineered toxin body targeting CD20, in mantle cell lymphoma," AACR Annual Meeting Abstract (2017).
Huang, S. et al. "AACR 2017 | Poster 3651/24—Preclinical examination of the effects of a CD20-specific engineered toxin body, MT-3724, in Mantle Cell Lymphoma," AACR Annual Meeting, Poster 3651/24 (2017).
Iberg, A. et al., "Design and Characterization of Bispecific Engineered Toxin Bodies for Targeted Cancer Therapy," Proceedings: American Association for Cancer Research (AACR) Annual Meeting 2019, Poster #2984 (2019).
Ishikawa, S. et al., "Protection against Shiga Toxin I Challenge by Immunization of Mice with Purified Mutant Shiga Toxin 1," Infection and Immunity, 71(6):3235-3239 (2003).

(56) References Cited

OTHER PUBLICATIONS

Jackson, R. L. et al., "Mutational analysis of the Shiga Toxin and Shiga-like toxin II enzymatic subunits," Journal of Bacteriology, 172(6):3346-3350 (1990).
Jackson, M. E. et al., "The KDEL retrieval system is exploited by Pseudomonas exotoxin A, but not by Shiga-like toxin-1, during retrograde transport from the Golgi complex to the endoplasmic reticulum," Journal of Cell Science, 112(4):467-475 (1999).
Jain, R. K., "Barriers to Drug Delivery in Solid Tumors," Scientific American, 271(1):58-65 (1994).
Jilani, I. et al., "Anti-Idiotype versus anti-mouse lg for detecting ritumixab," Blood, 103(10):3990 (2004).
Jilani, I. et al., "Transient down-modulation of CD20 by ritumixab in patients with chronic lymphocytic leukemia," Blood , 102(10):3514-3520 (2003).
Johannes, L. et al., "Retrograde Transport of KDEL-bearing B-fragment of Shiga Toxin," Journal of Biological Chemistry, 272(31):19554-19561 (1997).
Johannes, L. et al., "Shiga toxins-from cell biology to biomedical applications," Nature Reviews Microbiology, 8(2):105-116 (2010).
Johannes, L. & Decaudin, D., "Protein toxins: intracellular trafficking for targeted therapy," Gene Therapy, 12(18): 1360-1368 (2005).
Johnson, N. et al., "Construction of an epitope vector utilizing the diphtheria toxin B-subunit," FEMS Microbiology Letters, 146(1):91-96 (1997).
Jones, D. T., "Critically Assessing the State-of-the-art in Protein Structure Prediction," The Pharmacogenomics Journal, 1(2):126-134 (2001).
Jubala, C. M. et al., "CD20 Expression in Normal Canine B cells and in Canine non-Hodgkin Lymphoma," Veterinary Pathology, 42(4):468-476 (2005).
Kar, P. et al., "Current methods for the prediction of T-cell epitopes," Peptide Science, 110:e24046 (2018), 17 pages; https://doi.org/10.1002/pep2.24046.
Karanikas, V. et al., "Antibody and T Cell Responses of Patients with Adenocarcinoma Immunized with Mannan-MUC1 Fusion Protein," Journal of Clinical Investigation, 100(11): 2783-2792 (1997).
Karimova, G. et al., "Charge-dependent translocation of *Bordetella pertussis* adenylate cyclase toxin into eukaryotic cells: Implication for the in vivo delivery of CD8+ T cell epitopes into antigen-presenting cells," Proc. Natl. Acad. Sci. USA, 95:12532-12537 (1998).
Kelland, L. R., "'Of mice and men': values and liabilities of the athymic nude mouse model in anticancer drug development," European Journal of Cancer, 40(6):827-836 (2004).
Kim, G. B. et al., "A fold-back single chain diabody format enhances the bioactivity of an anti-monkey CD3 recombinant diphtheria toxin-based immunotoxin," Protein Engineering, 20(9): 425-432 (2007).
Kotera, Y. et al., "Humoral Immunity against a Tandem Repeat Epitope of Human Mucin MUC-1 in Sera from Breast, Pancreatic, and Colon Cancer Patients," Cancer Research 54(11):2856-2860 (1994).
Kochenderfer, J. N. et al., "Construction and Pre-clinical Evaluation of an Anti-CD 19 Chimeric Antigen Receptor," J Immunother., 32(7):689-702 (2009).
Kowanetz, M. et al., "Differential regulation of PD-L1 expression by immune and tumor cells in NSCLC and the response to treatment with atezolizumab (anti-PD-L1)," PNAS, 115(43):e10119-e10126 (2018).
Kurmanova, A. et al., "Structural requirements for furin-induced cleavage and activation of Shiga toxin," Biochemical and Biophysical Research Communications, 357(1):144-149 (2007).
Kyu, E., "Characterization of the A subunit mutants of Stx1 and Stx2 in *Saccharomyces cerevisiae*," Thesis, Rutgers, The State University of New Jersey, New Brunswick, retrieved from http://dx.doi.org/doi:10.7282/T34F1QWJ (2009), 57 pages.
Lakhrif, Z. et al., "A method to confer protein L binding ability to any antibody fragment," MAbs, 8(2):379-388 (2016).
Lambert, J. et al., "Purified Immunotoxins that are reactive with Human Lymphoid Cells: Monoclonal antibodies conjugated to the ribosome-inactivating proteins gelonin and the pokeweed antiviral proteins," Journal of Biological Chemistry, 260(22):12035-12041 (1985).
Lapointe, P. et al., "A Role for the Protease-sensitive Loop Region of Shiga-like Toxin 1 in the Retrotranslocation of its A Domain from the Endoplasmic Reticulum Lumen," Journal of Biological Chemistry, 280(24):23310-23318 (2005).
Laske, D. W. et al., "Intraventricular Immunotoxin Therapy for Leptomeningeal Neoplasia," Neurosurgery, 41(5):1039-1051 (1997).
Law, C. L. et al., "Efficient Elimination of B-Lineage Lymphomas by Anti-CD20-Auristatin Conjugates," Clinical Cancer Research, 10(23):7842-7851 (2004).
Lazar, E. et al., "Transforming Growth Factor alpha: Mutation of Aspartic Acid 47 and Leucine 48 Results in Different Biological Activities," Molecular and Cellular Biology, 8(3):247-1252 (1988).
Lea, N. et al., "Proteolytic cleavage of the A subunit is essential for maximal cytotoxicity of *Escherichia coli* O157:h7 Shiga-like toxin-1," Microbiology, 145(5):999-1004 (1999).
Lee, J. E. et al.."Phylogenetic analysis of Shiga toxin 1 and Shiga toxin 2 genes associated with disease outbreaks," BMC Microbiology, 7(1):109 (2007), 12 pages; doi.org/10.1186/1471-2180-7-109.
Lee, H. T. et al., "Molecular mechanism of PD-1/PD-L1 blockade via anti-PD-L1 antibodies atezolizumab and durvalumab," Scientific Reports, 7(1):5532 (2017), 12 pages; doi: 10.1038/s41598-017-06002-8.
Lee, R. S. et al., "Major histocompatibility complex class I presentation of exogenous soluble tumor antigen fused to the B-fragment of Shiga toxin," European Journal of Immunology, 28: 2726-2737 (1998).
Lehmann, C. H. K. et al., "Direct Delivery of Antigens to Dendritic Cells via Antibodies Specific for Endocytic Receptors as a Promising Strategy for Future Therapies," Vaccines, 4(2):1-32 (2016).
Lev, A. et al., "Tumor-specific Ab-mediated targeting of MHC-peptide complexes induces regression of human tumor xenografts in vivo," PNAS, 101(24):9051-9056 (2004).
Li, H. et al., "The CD20 Calcium Channel is Localized to Microvilli and Constitutively Associated with Membrane Rafts: Antibody binding increases the affinity of the association through an epitope-dependent cross-linking-independent mechanism," Journal of Biological Chemistry, 279(19):19893-19901 (2004).
Li, B. et al., "Development of Novel Tetravalent Anti-CD20 Antibodies with Potent Antitumor Activity," Cancer Research, 68(7):2400-2408 (2008).
Li, M. et al., "Clinical targeting recombinant immunotoxins for cancer therapy," Onco Targets and Therapy, 10:3645-3665 (2017).
Li, Y. et al., "Correction to: Discovery and preclinical characterization of the antagonist anti-PD-L1 monoclonal antibody LY3300054," Journal for ImmunoTherapy of Cancer, vol. 6, No. 1, Jun. 2018, p. 1.
Lim, S. H. et al., "Fc gamma receptor lib on target B cells promotes ritumixab internalization and reduces clinical efficacy," Blood, 118(9):2530-2540 (2011).
Ling, H. et al., "Structure of the Shiga-like Toxin I B-Pentameter complexed with an Analogue of Its Receptor Gb3," Biochemistry, 37(7):1777-1788 (1998).
Luqman, M. et al., "The antileukemia activity of a human antiCD40 antagonist antibody, HCD122, on human chronic lymphocytic leukemia cells," Blood, 112(3):711-720 (2008).
Lyu, M. -A. et al., "Cell-targeting fusion constructs containing recombinant gelonin," Methods in Enzymology, 502:167-214 (2012).
Maak, M. et al., "Tumor-Specific Targeting of Pancreatic Cancer with Shiga Toxin B-Subunit," Molecular Cancer Therapeutics, 10(10):1918-1928 (2011).
Mallard, F. et al., "Direct Pathway from Early/Recycling Endosomes to the Golgi Apparatus Revealed through the Study of Shiga Toxin B-fragment Transport," The Journal of Cell Biology, 143(4):973-990 (1998).
Mascarell, L. et al., "Induction of Neutralizing Antibodies and Th 1 -Polarized and CD4-Independent CD8+ T-Cell Responses following Delivery of Human Immunodeficiency Virus Type 1 Tat Protein by

(56) References Cited

OTHER PUBLICATIONS

Recombinant Adenylate Cyclase of Bordetella pertussis," Journal of Virology, 79(15):9872-9884 (2005).
Mazor, Y. et al., "chFRP5-ZZ-PE38, a large IgG-toxin immunoconjugate outperforms the corresponding smaller FRP5(Fv)-ETA immunotoxin in eradicating ErbB2-expressing tumor xenografts," Cancer Letters, 257(1):124-135 (2007).
Mazor, R. et al., "Identification and elimination of an immunodominant T-cell epitope in recombinant immunotoxins based on Pseudomonas exotoxin A," Proceedings of the National Academy of Sciences U.S.A., 109(51):E3597-E3603 (2012).
McCluskey, A. J. et al., "The Catalytic Subunit of Shiga-like Toxin 1 Interacts with Ribosomal Stalk Proteins and is Inhibited by Their Conserved C-Terminal Domain," Journal of Molecular Biology, 378(2):375-386 (2008).
McCluskey et al., "Shiga-like Toxin 1: Molecular Mechanism of Toxicity and Discovery of Inhibitors", Thesis University of Toronto (2010); retrieved from the Internet: http://hdl.handle.net/1807/32046.
McCluskey et al., "Charged and hydrophobic Surfaces on the A chain of Shiga-like Toxin 1 recognize the C-terminal Domain of Ribosomal Stalk Proteins," PLoS One 7(2):e31191 (2012).
McKenzie, J, et al., "Passage through the Golgi is necessary for Shiga toxin B subunit to reach the endoplasmic reticulum," The FEBS Journal, 276(6):1581-1595, 2008.
Meeting Abstracts, "33rd Annual Meeting & Pre-Conference Programs of the Society for Immunotherapy of Cancer (SITC 2018)," Washington, D.C., USA, Nov. 7-11, 2018, Journal for ImmunoTherapy of Cancer, vol. 6, Supplement No. 1, Nov. 2018, pp. 1-205.
Meeting Abstracts, "34th Annual Meeting & Pre-Conference Programs of the Society for Immunotherapy of Cancer (SITC 2019): Part 2: National Harbor, MD, USA, Nov. 10, 2019," Journal for ImmunoTherapy of Cancer, vol. 7, Supplement No. 1, Nov. 2019, pp. 1-237, Abstract P804.
Michel, R. B. et al., "Intracellular Accumulation of the Anti-CD20 Antibody 1F5 in B-Lymphoma Cells," Clinical Cancer Research, 8(8):2701-2713 (2002).
Miller, R. B. et al., "Design, Construction, and In-Vitro analyses of Multivalent Antibodies," Journal of Immunology, 170(9):4854-4861 (2003).
Moise, L. et al., "T cell epitope engineering: an avian H7N9 influenza vaccine strategy for pandemic preparedness and response," Human Vaccines & Immunotherapeutics, 14(9):2203-2207 (2018).
Molecular Templates, Molecular Templates Provides Corporate Update and Outlines 2020 Milestones, Jan. 8, 2020, 2 pages.
Molecular Templates, Inc., R&D Day, Conference Call Transcript, Nov. 15, 2019, Fair Disclosure Wire, pp. 1-17; retrieved on Jan. 15, 2021 from https://dialog.proquest.com/professional/docview/2320577373.
Molecular Templates Corporate Presentation, Nov. 2019, 26 pages.
Newland, J. W. et al., "Cloning of Genes for Production of Escherichia coli Shiga-Like Toxin Type II," Infection and Immunity, 55(11):2675-2680 (1987).
Ninkovic, T. et al., "Identification of O-glycosylated decapeptides within the MUC1 repeat domain as potential MHC class I (A2) binding epitopes," Molecular Immunology 47(1):131-140 (2009).
Noakes, K. L. et al., "Exploiting retrograde transport of Shiga-like Toxin 1 for the delivery of exogenous antigens into the MHC class I presentation pathway," FEBS Letters, 453(1-2):95-99 (1999).
Ogishi, M. & Yotsuyanagi, H., "Quantitative Prediction of the Landscape of T Cell Epitope Immunogenicity in Sequence Space," Frontiers in Immunology, vol. 10, Article 827, pp. 1-20 (2019).
Ohmura, M. et al., "Characterization of non-toxic mutant toxins of Vero toxin I that were constructed by replacing amino acids in the A subunit," Microbial Pathogenesis, 15(3):169-176 (1993).
Olafsen, T. et al., "Recombinant Anti-CD20 Antibody fragments for Small-Animal PET Imaging of B-Cell Lymphomas," Journal of Nuclear Medicine, 50(9):1500-1508 (2009).
Olafsen, T. et al., "ImmunoPET imaging of B-cell lymphoma using anti-CD20 scFv dimers (diabodies)," Protein Engineering, Design & Selection, 23(4):243-249 (2010).
Oloomi, M. et al., "In vivo characterization of Fusion Protein Comprising of A1 Subunit of Shiga Toxin and Human GM-CSF: Assessment of Its immunogenicity and Toxicity," Iranian Biomedical Journal, 14(4):136-141 (2010).
Onda, M. et al., "An immunotoxin with greatly reduced immunogenicity by identification and removal of B cell epitopes," Proceedings of the National Academy of Sciences U.S.A., 105(32):11311-11316 (2008).
Osicka, R. et al., "Delivery of CD8+ T-cell epitopes into major histocompatibility complex class I antigen presentation," Infection and Immunity, 68(1 ):247-256 (2000).
Pai-Scherf, L. H. et al., "Hepatotoxicity in Cancer Patients Receiving erb-38, a Recombinant Immunotoxin that Targets the erbB2 Receptor," Clinical Cancer Research, 5(9):2311-2315 (1999).
Pastan, I. et al., "Immunotoxin Treatment of Cancer," Annual Review of Medicine, 58:221-237 (2007).
Paul, W. E. (Ed.) "Fundamental Immunology" 3rd Edition, Raven Press, 292-295 (1993).
Peng, K. W. et al., "Oncolytic measles viruses displaying a single-chain antibody against CD38, a myeloma cell marker," Blood, 101(7):2557-2562 (2003).
Perampalam, S. et al., "Designing combinatorial protein libraries based on a protein toxin template," Molecular & Cellular Proteomics, American Society for Biochemistry and Molecular Biology, Inc., US, vol. 2, No. 9, Jan. 11, 2003, p. 868.
Perampalam, S. et al., "Designing combinatorial protein libraries based on a protein toxin template," HUPO 2nd Annual & IUBMB IXI World Congress, Oct. 8-11, Montreal, Poster Session 28 Proteomics & Biotechnology, 80.16 (Oct. 2003).
Perampalam, S. et al., "Cell-targeted Ribosome-Inactivating Proteins derived from Protein Combinatorial Libraries," Thesis-University of Toronto (2008), 172 pages.
Peterson, J. K. et al., "Integrating pharmacology and in vivo cancer models in preclinical and clinical drug development," European Journal of Cancer, 40(6):837-844 (2004).
Pirie, C. M. et al., "Convergent Potency of Internalized Gelonin Immunotoxins across Varied Cell Lines, Antigens, and Targeting Moieties," Journal of Biological Chemistry, 286(6):4165-4172 (2011).
Pisarev, V. M. et al., "T cells recognize PD(N/T)R motif common in a variable number of tandem repeat and degenerate repeat sequences of MUC1," International Immunopharmacology, 5(2):315-330 (2005).
Polito, L. et al., "The Conjugate Rituximab/saporin-S6 completely inhibits clonogenic growth of CD20-expressing cells and produces a synergistic toxic effect with Fludarabine," Leukemia 18(7):1215-1222 (2004).
Polito, L. et al., "Saporin-S6: A Useful Tool in Cancer Therapy," Toxins, 5:1698-1722 (2013).
Polson, A. G. et al., "Antibody-Drug Conjugates for the Treatment of Non-Hodgkin's Lymphoma: Target and Linker-Drug Selection," Cancer Research, 69(6):2358-2364 (2009).
Press, O. W. et al., "Endocytosis and Degradation of Monoclonal Antibodies Targeting Human B-Cell Malignancies," Cancer Research, 49(17):4906-4912 (1989).
Press, O. et al., "Retention of B-Cell Specific Monoclonal Antibodies by Human Lymphoma Cells," Blood, 83(5): 1390-1397 (1994).
Preville, X, et al., "Eradication of Established Tumors by Vaccination With Recombinant Bordetella pertussis Adenylate Cyclase Carrying the Human Papillomavirus 16 E7 Oncoprotein," Cancer Research, 65(2):641-649 (2005).
Protein ID ABM97743, European Molecular Biology Laboratory (EMBL), Oloomi, M, et al., "synthetic construct partial A1-GMCSF chimeric protein", Sep. 10, 2007.
Promega Technical Reference, Amino Acids, 2018.
Rajagopalan, S. et al.,"CD-20 Specific Engineered Toxin Body Demonstrates Direct Cell Kill of Multiple B-Cell Non-Hodgkin's Lymphoma Types," Blood, 122(21):5152 (2013).
Rajagopalan, S. et al., "CD20-specific Engineered Toxin Body demonstrates direct cell kill of multiple B-cell Non-Hodgkin's

(56) References Cited

OTHER PUBLICATIONS lymphoma types," The Journal of Cancer Research, 74(19 Suppl): Abstract # 647, (Oct. 1, 2014); Proceedings: AACR Annual Meeting 2014 (Apr. 5-9, 2014).

Rajagopalan, S. et al,. "CD20-specific Engineered Toxin Body demonstrates direct cell kill of multiple B-cell non-Hodgkin's lymphoma types," The Journal of Cancer Research, 74(19 Suppl):Abstract nr 647.

Rajagopalan, S, et al., "CD38-specific engineered toxin body: Therapeutic potential for multiple myeloma", The Journal of Cancer Research, 74(19 Suppl): Abstract #671, (Oct. 1, 2014) from American Association for Cancer Research (AACR) Annual Meeting 2014, (Apr. 5-9, 2014).

Rajagopalan, S. et al., "CD38-specific engineered toxin body: Therapeutic potential for multiple myeloma," The Journal of Cancer Research, 74(19 Suppl): Abstract nr 671 (Oct. 1, 2014).

Rajagopalan, S. et al., "HER2-targeted engineered toxin body demonstrates selective binding and cell kill of HER2-overexpressing breast cancer," The Journal of Cancer Research, 73(8 Suppl): Abstract #868 (Apr. 15, 2013).

Rajagopalan, S. et al., "HER2-targeted engineered toxin body demonstrates selective binding and cell kill of HER2-overexpressing breast cancer," Proceedings: American Association for Cancer Research (AACR) Annual Meeting 2013, Abstract # 868 (Apr. 6-10, 2013).

Rajagopalan, S. et al., "Next-generation engineered toxin bodies: CD38, PD-L1 and HER2 targeted ETBs," American Association for Cancer Research (AACR) Annual Meeting, 2016, Abstract #595 (Apr. 16-20, 2016).

Rajagopalan, S. et al., "Next-generation engineered toxin bodies: CD38, PD-L1 and HER2 targeted ETBs," The Journal of Cancer Research, 76(14 Suppl) (Jul. 15, 2016), Abstract nr 595.

Rajagopalan, S. et al., "A novel targeted engineered toxin body for treatment of HER2 positive breast cancer," Thirty-Seventh Annual CTRC-AACR San Antonio Breast Cancer Symposium, nr P4-15-17 (Dec. 9-13, 2014).

Ramakrishnan, S. & Houston, L., "Comparison of the Selective Cytotoxic Effects of Immunotoxins Containing Ricin A Chain or Pokeweed Antiviral Protein and Anti-Thy 1.1 Monoclonal Antibodies," Cancer Research, 44(1 ):201-208 (1984).

Ramos, H. J. et al., Abstract 3900, "The safety and efficacy profile of a PD-L1 directed, Engineered Toxin Body, as a novel targeted direct-cell kill approach for the treatment of PD-L1 expressing cancers," Molecular Templates, AACR Annual Meeting 2019; Mar. 29-Apr. 3, 2019; Atlanta, GA, AACR 2019, 2 pages.

Robinson, G. L. et al., "In vivo efficacy of a CD38-specific engineered toxin body," Clinical Cancer Research, 21(17 Suppl) (Sep. 21, 2015), Abstract A15.

Robinson, G. L. et al., "In vivo efficacy of a CD38-specific engineered toxin body," Proceedings: American Association for Cancer Research (AACR) Special Conference on Hematologic Malignancies: Translating Discoveries to Novel Therapies, Poster A15 (Sep. 21, 2015).

Robinson, G. L. et al., "MT-3724, an engineered toxin body targeting CD20 for non-Hodgkin's lymphoma," Proceedings: American Association for Cancer Research (AACR) 107th Annual Meeting 2016, Abstract #1483 (Apr. 6-10, 2016).

Robinson, G. L. et al., "MT-4019: a de-immunized engineered toxin body targeting CD38 for multiple myeloma," Proceedings: American Association for Cancer Research (AACR) Annual Meeting 2017, Poster, Abstract 2659 (Apr. 1-5, 2017).

Robinson, G. L. et al., "MT-3724, an engineered toxin body targeting CD20 for non-Hodgkin's lymphoma," Proceedings of the 107th Annual Meeting of the American Association for Cancer Research, Cancer Research, Jul. 15, 2016, 76(14 Suppl), Abstract 1483.

Romaniuk, S. I. et al., "Recombinant Diphtheria toxin derivatives: Perspectives of application," Russian Journal of Bioorganic Chemistry, 38(6):565-577 (2012).

Rosenthal, A. et al., "A phase 2 study of lenalidomide, rituximab, cyclophosphamide, and dexamethasone (LR-CD) for untreated low-grade non-Hodgkin lymphoma requiring therapy," Am J Hematol., 92(5):467-472 (2017).

Rossi, E. A. et al., "Novel Designs of Multivalent Anti-CD20 Humanized Antibodies as Improved Lymphoma Therapeutics," Cancer Research, 68(20):8384-8392 (2008).

Roudkenar, M. H. et al., "Selective cytotoxicity of recombinant STXA1-GM-CSF protein in hematopoietic cancer cells," Cell Biology and Toxicology, 22(3):213-219 (2006).

Rudikoff, S. et al., "Single amino acid substitution altering antigen-binding specificity," Proceedings of the National Academy of Sciences of the USA, 79(6):1979-1983 (1982).

Saijo, N. "What are the reasons for negative phase III trials of molecular-target-based drugs?" Cancer Science 95(10)772-776 (2004).

Sandvig, K. et al., "Protein toxins: mode of action and cell entry," Biochemical Society Transactions, 20(4):724-727 (1993).

Sandvig, K. et al., "Entry of Shiga Toxin into Cells," Zentralblatt fiir Bakteriologie, 278(2-3):296-305 (1993).

Saron, M. F. et al., "Anti-viral protection conferred by recombinant adenylate cyclase toxins from Bordetella pertussis carrying a CD8+ T cell epitope from lymphocytic choriomeningitis virus," Proceedings of the National Academy of Sciences U.S.A., 94(7):3314-3319 (1997).

Schindler, J. et al., "A Phase I Study of a Combination of anti-CD19 and anti-CD22 Immunotoxins (Combotox) in Adult Patients with Refractory B-Lineage Acute Lymphoblastic Leukemia," British Journal of Haematology, 154(4):1-11 (2011).

Schlecht, G. et al., "Antigen Targeting to CD11b Allows Efficient Presentation of CD4+ and CD8+ T Cell Epitopes and In Vivo Th1-Polarized T Cell Priming," The Journal of Immunology, 173(10):6089-6097 (2004).

Schuh, J. C., "Trials, Tribulations, and Trends in Tumor Modeling in Mice," Toxicologic Pathology, 32(Suppl. 1):53-66 (2004).

Schultz, J. C. et al., "A Tetravalent Single-chain Antibody-Streptavidin Fusion Protein for Pretargeted Lymphoma Therapy," Cancer Research, 60(23):6663-6669 (2000).

Schumacher, F. -R. et al., "Building proteomic tool boxes to monitor MHC class I and class II peptides," Proteomics, 17(1-2) (2017), 16 pages; doi: 10.1002/pmic.201600061.

Sebo, P. et al., "Cell-Invasive Activity of Epitope-Tagged Adenylate Cyclase of Bordetella pertussis allows In Vitro Presentation of a Foreign Epitope to CD8+ Cytotoxic T Cells," Infection and Immunity, 63(10):3851-3857 (1995).

Sebo, P. et al., "In vivo induction of CTL responses by recombinant adenylate cyclase of Bordetella pertussis carrying multiple copies of a viral CD8+ T-cell epitope," FEMS Immunology & Medical Microbiology, 26(2):167-173 (1999).

Shan, D. et al., "Characterization of scFV-Ig Constructs Generated from the Anti-CD20 mAb 1F5 Using Linker Peptides of Varying Lengths," Journal of Immunology, 162(11):6589-6595 (1999).

Shaw, C. A. et al., "Stimulation of CD8+ T Cells following Diphtheria Toxin-Mediated Antigen Delivery into Dendritic Cells," Infection and Immunity, 74(2):1001-1008 (2006).

Shen, G. L. et al., "Evaluation of four CD22 antibodies as ricin A chain-containing immunotoxins for the in vivo therapy of human B-cell leukemias and lymphomas," International Journal of Cancer, 42(5):792-797 (1988).

Shete, V., "Generation and characterization of random site-directed mutants of Shiga-like toxin 1A by *Escherichia coli* 0157:H7 in *Saccharomyces cerevisiae*," Thesis, Rutgers, The State University of New Jersey, New Brunswick (2009), retrieved from http://dx.doi.org/doi:10.7282/T300029Z.

Shiba, Y. et al., "AGAP2 regulates retrograde transport between early endosomes and the TGN," Journal of Cell Science, 123(Pt 14):2381-2390 (2010).

Sieber, T. et al., "Selective internalization of monoclonal antibodies by B-cell chronic lymphocytic leukemia cells," 121(3):458-461 (2003).

Simsova, M et al., "The adenylate cyclase toxin from Bordetella pertussis—a novel promising vehicle for antigen delivery to dendritic cells," International Journal of Medical Microbiology, 239:571-576 (2004).

(56) References Cited

OTHER PUBLICATIONS

Singh, N. K. et al., "Emerging Concepts in TCR Specificity: Rationalizing and (Maybe) Predicting Outcomes," J Immunol, 199:2203-2213 (2017).
Sivam, G. et al., "Immunotoxin to a Human Melanoma-associated Antigen: Comparison of Gelonin with Ricin and Other A Chain Conjugates," Cancer Research, 47(12):3169-3173 (1987).
Skinner, L. M. & Jackson, M. P., "Investigation of ribosome binding by the Shiga Toxin A1 subunit, using competition and site-directed mutagenesis," Journal of Bacteriology, 179(4): 1368-1374 (1997).
Skinner, L. M. & Jackson, M. P., "Inhibition of prokaryotic translation by the Shiga toxin enzymatic subunit," Microbial Pathogenesis, 24(2):117-122 (1998).
Smith, D. C. et al., "Exogenous Peptides Delivered by Ricin Require Processing by Signal Peptidase for Transporter Associated with Antigen Processing-Independent MHC Class I-Restricted Presentation," The Journal of Immunology, 169(1):99-107 (2002).
Stenmark, H. et al., "Peptides fused to the amino-terminal end of Diphtheria toxin are translocated to the cytosol," The Journal of Cell Biology, 113(5):1025-1032 (1991).
Stepanov, A. et al., "Design of Targeted B Cell Killing Agents," PLoS One, 6(6):e20991 (2011); doi:10.1371/journal.pone.0020991, 10 pages.
Strop, P. et al., "Location Matters: Site of Conjugation Modulates Stability and Pharmacokinetics of Antibody Drug Conjugates," Chemistry & Biology, 20:161-167 (2013).
Su, H. et al., "Clinical grade production and characterization of a fusion protein comprised of the chemokine CCL2-ligand genetically fused to a mutated and truncated form of the Shiga A1 subunit," Protein Expression and Purification, 66(2):149-157 (2009).
Suh, J. K. et al., "Shiga Toxin Attacks Bacterial Ribosomes as Effectively as Eucaryotic Ribosomes," Biochemistry, 37(26):9394-9398 (1998).
Suhan, M. L. et al., "Disruption of an Internal Membrane-Spanning Region in Shiga Toxin I Reduces Cytotoxicity," Infection and Immunity, 66(11):5252-5259 (1998).
Tacken, P. J. et al., "Effective induction of naive and recall T-cell responses by targeting antigen to human dendritic cells via a humanized anti-DC-SIGN antibody," Blood, 106(4): 1278-85 (2005).
Tesh, V. L. et al., "Comparison of the Relative Toxicities of Shiga-Like Toxins Type I and Type II for Mice," Infection and Immunity, 61(8):3392-3402 (1993).
Thompson, J. et al., "Improved binding of a bivalent single-chain immunotoxin results in increased efficacy for in vivo T-cell depletion," Protein Engineering, 14(12):1035-1041 (2001).
Thorpe, P. E. et al., "Cytotoxicity Acquired by Conjugation of an Anti-Thy1.1 Monoclonal Antibody and the Ribosome-Inactivating Protein, Gelonin," European Journal of Biochemistry, 116(3):447-454 (1981).
Torgersen, M. L. et al., "The A-subunit of surface-bound Shiga toxin stimulates clathrin-dependent uptake of the toxin," The FEBS Journal, 272(16):4103-4013 (2005).
Tosatto, C. E. et al., "Large-Scale Prediction of Protein Structure and Function from Sequence," Current Pharmaceutical Design, 12(17):2067-2086 (2006).
Vallera, D. A. et al., "Bioengineering a unique deimmunized bispecific targeted toxin that simultaneously recognizes human CD22 and CD19 Receptors in a mouse model of B-Cell metastases," Molecular Cancer Therapeutics, 9(6):1872-1883 (2010).
Varner, C. T. et al., "Recent Advances in Engineering Polyvalent Biological Interactions," Biomacromolecules, 16(1):43-55 (2014).
Vernet, E. et al., "Affinity-based entrapment of the HER2 receptor in the endoplasmic reticulum using an affibody molecule," Journal of Immunological Methods, 338:1-6 (2008).
Vervoordeldonk, S. F. et al., "Preclinical studies with radiolabeled monoclonal antibodies for treatment of patients with B-cell malignancies," Cancer, 73(3):1006-1011 (1994).
Vingert, B. et al., "The Shiga toxin B-subunit targets antigen in vivo to dendritic cells and elicits anti-tumor immunity," European Journal of Immunology, 36(5):1124-1135 (2006).
Von Minckwitz, G. et al., "Phase I clinical study of the recombinant antibody toxin scFv(FRP5)-ETA specific for the ErbB2/HER2 receptor in patients with advanced solid malignomas," Breast Cancer Research, 7(5):R617-R626 (2005).
Voskoglou-Nomikos, T. et al., "Clinical Predictive Value of the In Vitro Cell Line, Human Xenograft, and Mouse Allograft Preclinical Cancer Models," Clinical Cancer Research, 9(11): 4227-4239 (2003).
Wales, R. et al., "Addition of an endoplasmic reticulum retrieval sequence to ricin A chain significantly increases its cytotoxicity to mammalian cells," Journal of Biological Chemistry, 268(32):23986-23990 (1993).
Wang, E. et al., "T-cell-directed cancer vaccines: the melanoma model," Expert Opinion on Biological Therapy, 1(2):277-290 (2001).
Wargalla, U. D. & Reisfeld, R. A., "Rate of internalization of an immunotoxin correlates with cytotoxic activity against human tumor cells," PNAS USA, 86(13):5146-5150 (1989).
Weinstein, D. et al., "In vivo formation of hybrid toxins comprising Shiga toxin and the Shiga-like toxins and role of the B subunit in localization and cytotoxic activity," Infection and Immunity, 57(12):3743-3750 (1989).
Weldon, J. E. & Pastan, I., "A guide to taming a toxin: recombinant immunotoxins constructed from Pseudomonas exotoxin A for the treatment of cancer," FEBS Journal, 278(23):4683-4700 (2011).
Wels, W. et al., "Selective Inhibition of Tumor Cell Growth by a Recombinant Single-Chain Antibody-Toxin Specific for the erbB-2 Receptor," Cancer Research, 52:6310-6317 (1992).
Willert, E. K. et al., "Engineered toxin bodies: A next-generation immunotoxin scaffold with novel immuno-oncology functionality," Proceedings: American Association for Cancer Research (AACR) Annual Meeting 2015, Abstract #2477 (Apr. 18-22, 2015).
Willert, E. K. et al., "A novel targeted engineered toxin body for treatment of HER2 positive breast cancer," The Journal of Cancer Research, 75(9 Suppl) Abstract nr P4-15-17 (May 1, 2015).
Willert, E. K. et al., "Engineered toxin bodies: A next-generation immunotoxin scaffold with novel immuno-oncology functionality," The Journal of Cancer Research, 75(15 Suppl): Abstract nr 2477 (Aug. 1, 2015).
Willert, E. K. et al., "TAK-169, an exceptionally potent CD38 targeted engineered toxin body, as a novel direct cell kill approach for the treatment of multiple myeloma," Proceedings: American Association for Cancer Research (AACR) Annual Meeting 2019, Poster #2384 (Apr. 1, 2019).
Windschiegl, B. et al., "Lipid Reorganization Induced by Shiga Toxin Clustering on Planar Membranes," PLoS One, 4(7):e6238 (2009).
Wirth, R. et al., "Engineered Toxin Body demonstrating CD20-specific binding and cell kill in B-Cell Non-Hodgkin lymphoma cells," Proceedings: American Association for Cancer Research (AACR) 104th Annual Meeting 2013, Abstract #5477 (Apr. 6-10, 2013).
Wirth, R. et al., "Engineered Toxin Body demonstrating CD20-specific binding and cell kill in B-Cell Non-Hodgkin lymphoma cells," [Abstract], In: Proceedings of the 104th Annual Meeting of the American Association for Cancer Research, Cancer Research, Apr. 15, 2013, 73(8 Suppl) Abstract #5477.
Wu, A. M. et al., "Multimerization of a chimeric anti-CD20 single chain Fv-Fc fusion protein is mediated through variable domain exchange," Protein Engineering, 14(12):1025-1033 (2001).
Wu, H. et al., "Humanization of a murine monoclonal antibody by simultaneous optimization of framework and CDR residues," J. Mol. Biol., 294:151-162 (1999).
Yamasaki, S. et al., "Importance of arginine at position 170 of the A subunit of Vero toxin 1 produced by enterohemorrahagic *Escherichia coli* fortoxin activity," Microbial Pathogenesis, 11(1):1-9 (1991).
Yu, L. et al., "Interaction between bevacizumab and murine VEGF-A: a reassessment," Investigative Ophthalmology & Visual Science, 49(2):522-527 (2008).
Zacny, V. et al., "Novel toxin library for the discovery of oncology therapeutics," Cancer Research, 70(8 Suppl), Abstract #5506 (Apr. 2010).
Zahid, M. et al., "Design and reshaping of an scFv directed against human platelet glycoprotein VI with diagnostic potential," Analytical Biochemistry, 417(2):274-282 (2011).

(56) References Cited

OTHER PUBLICATIONS

Zapata, G. et al., "Engineering linear F(ab')2 fragments for efficient production in *Escherichia coli* and enhanced antiproliferative activity," Protein Engineering, 8(10):1057-1062 (1995).

* cited by examiner

Figure 1-A. Schematic Drawing of the General Architecture of Exemplary, Shiga Toxin Effector Polypeptides Comprising an Amino Acid Substitution(s) Suitable for Conjugation and Examples with or without a Conjugate(s)
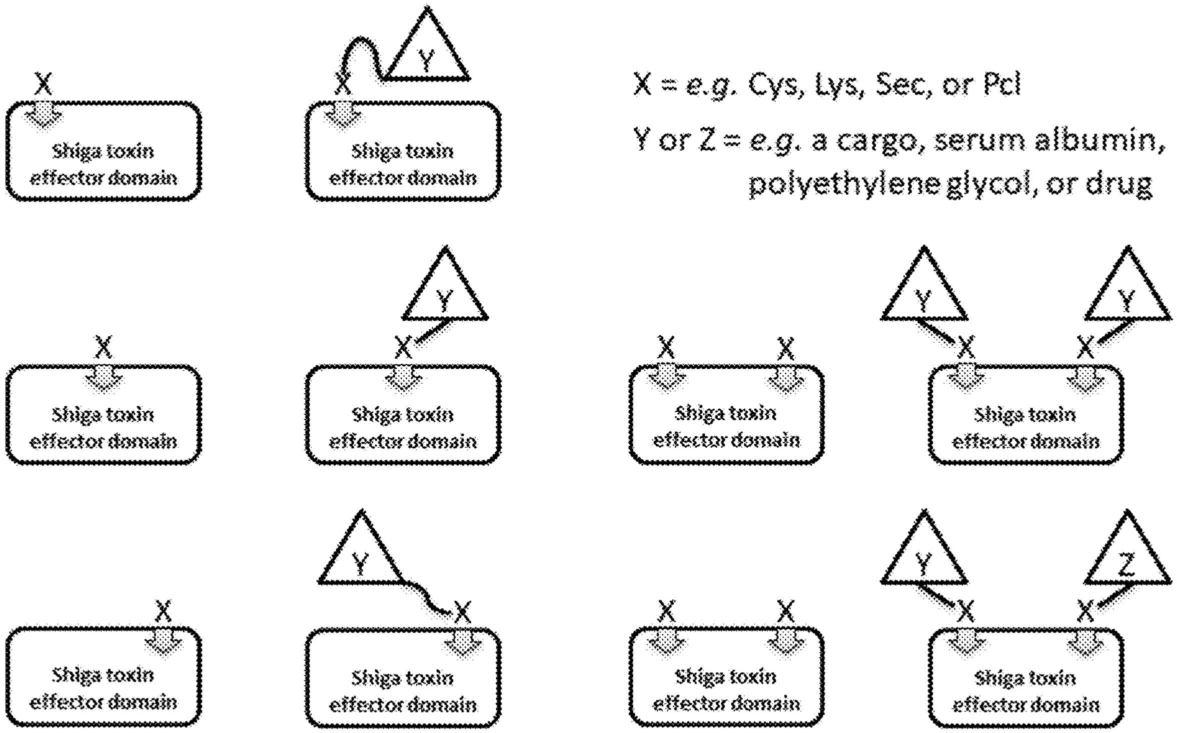

Figure 1-B. Schematic Drawing of the General Architecture of Exemplary, Cell-Targeting Molecules either with or without a Conjugate(s) Y and Z
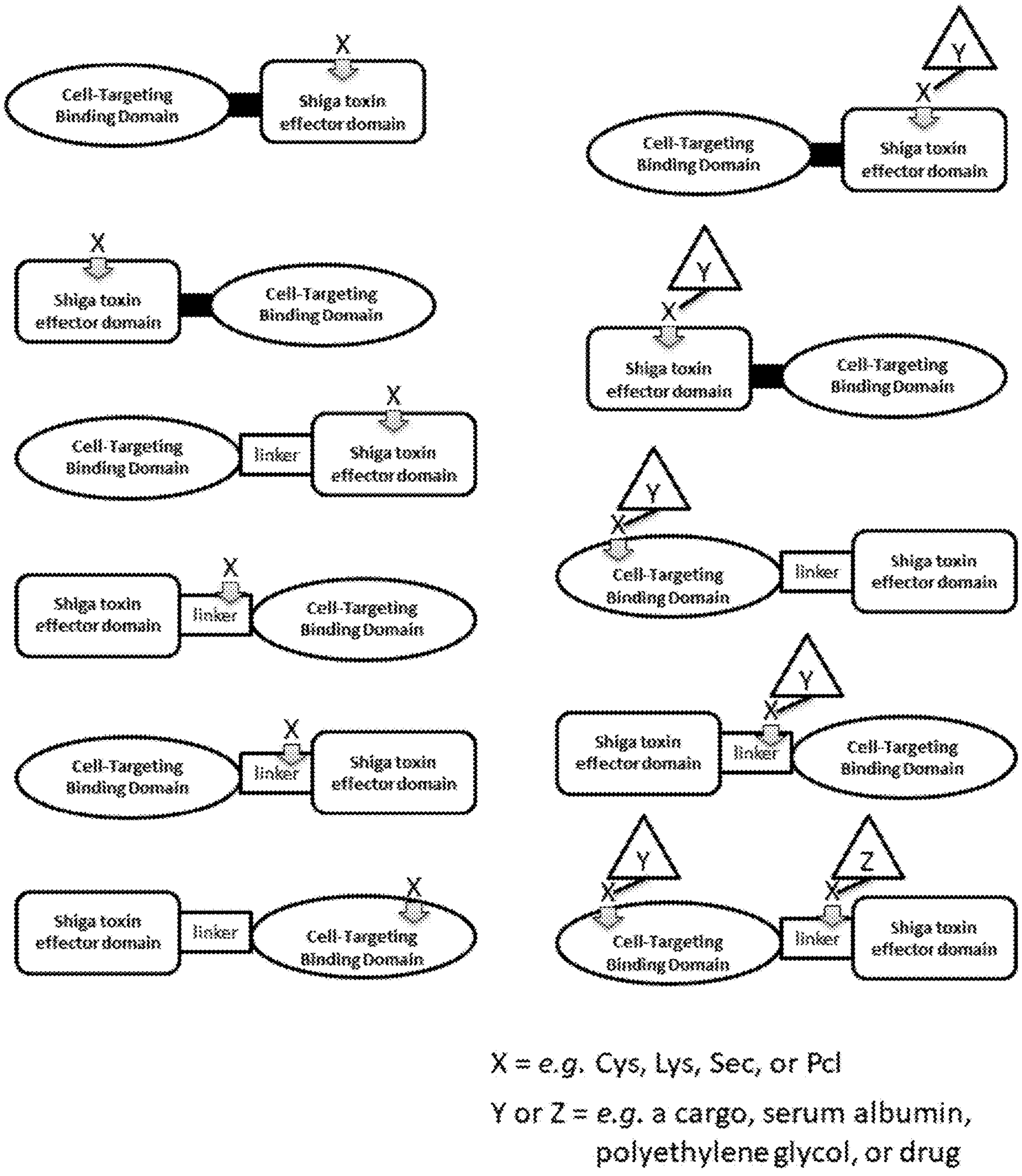

Figure 2. Specific and Potent Cytotoxicity of SLT-1A-Cys5::scFv1, SLT-1A-Cys7::scFv1, and SLT-1A-Cys10::scFv1 to Target Positive Cells
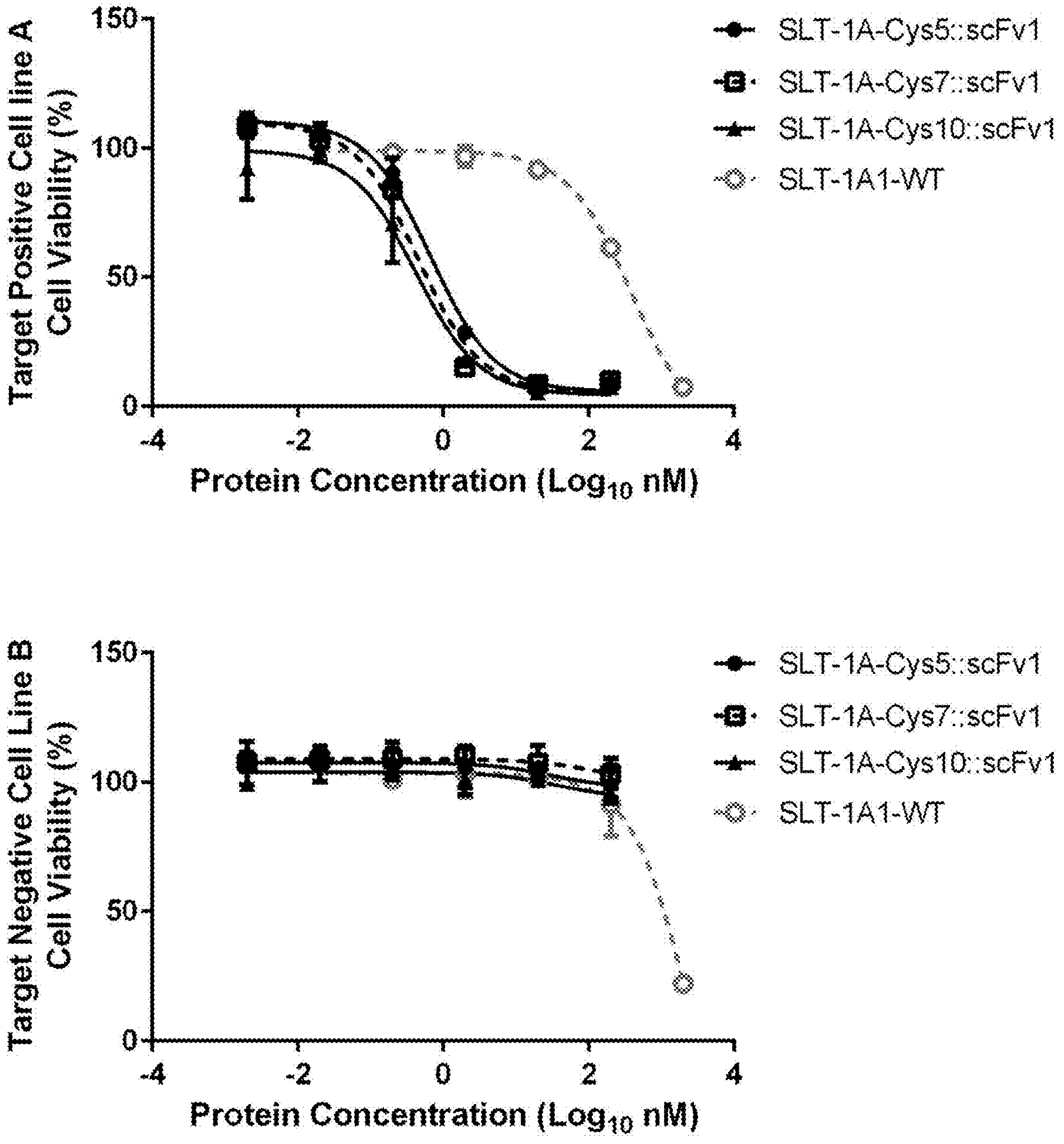

Figure 3. The Cytotoxic Activities of SLT-1A-Cys2-D1::scFv2, SLT-1A-Cys7-D1::scFv2, and SLT-1A-Cys8-D1::scFv1 Were Comparable to SLT-1A-D1::scFv2
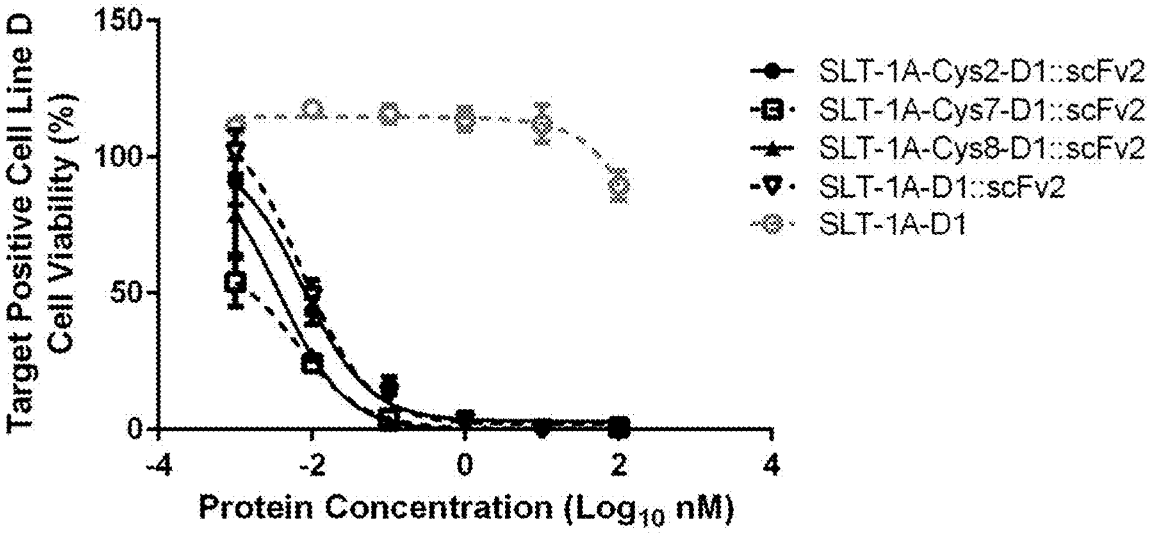
- ●— SLT-1A-Cys2-D1::scFv2
- ◻·  SLT-1A-Cys7-D1::scFv2
- ▲— SLT-1A-Cys8-D1::scFv2
- ▽·  SLT-1A-D1::scFv2
- ⊛·  SLT-1A-D1

Figure 4. The Cytotoxic Activities of SLT-1A-Cys11-D1::scFv2, SLT-1A-Cys15-D1::scFv2, and SLT-1A-Cys19-D1::scFv1 Were Comparable to SLT-1A-D1::scFv2
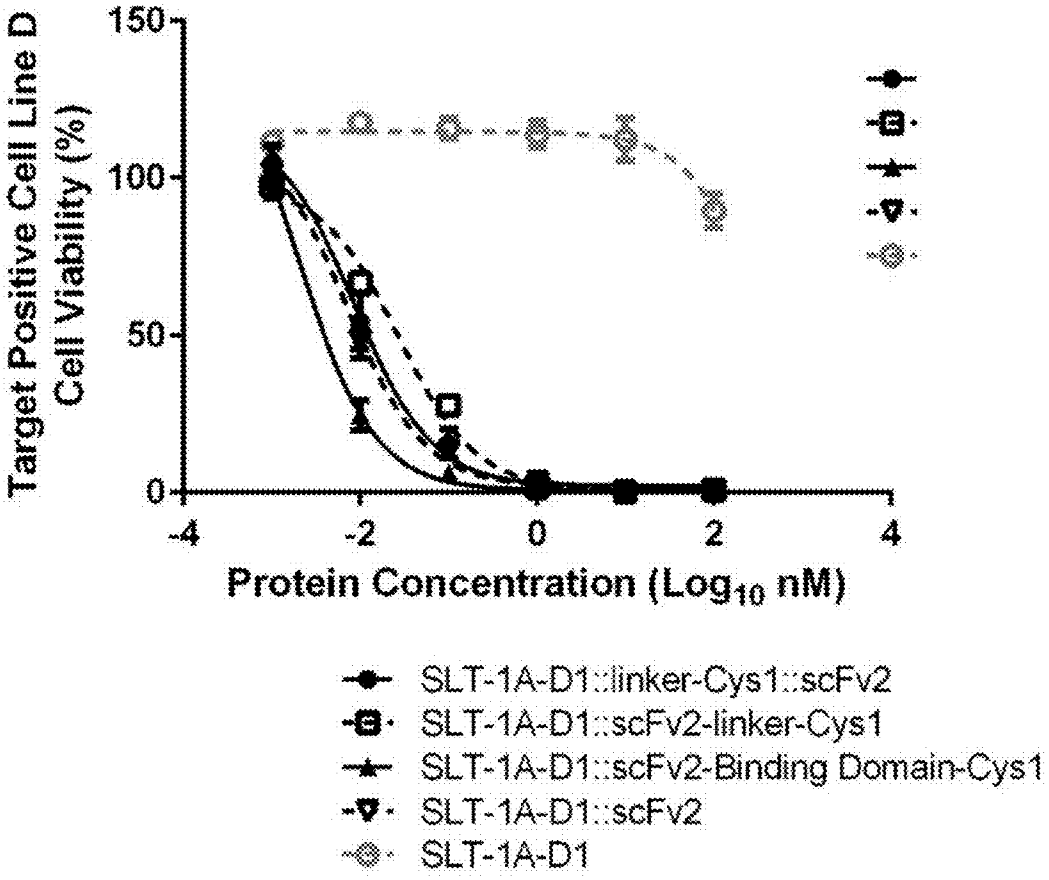
- ●— SLT-1A-D1::linker-Cys1::scFv2
- ▫— SLT-1A-D1::scFv2-linker-Cys1
- ▲— SLT-1A-D1::scFv2-Binding Domain-Cys1
- ▽— SLT-1A-D1::scFv2
- ◇— SLT-1A-D1

Figure 5. Analysis of Intermolecular Disulfide Bond Based Multimerization of Cell-Targeting Molecules Comprising SLT-1A-Cys2-D1, SLT-1A-Cys3-D1, or SLT-1A-Cys5-D1

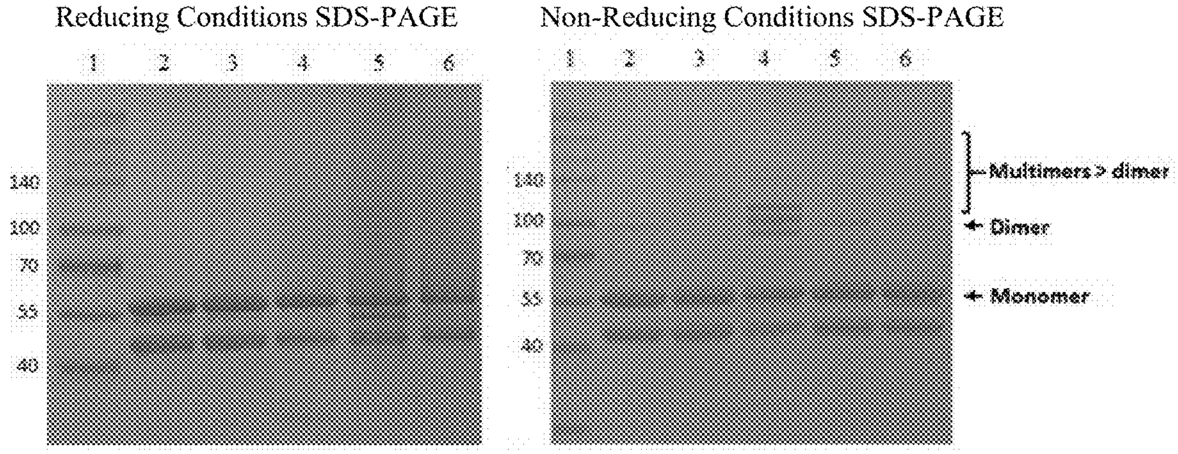

Lane 1 MW marker
Lane 2 SLT-1A-D1::scFv3
Lane 3 SLT-1A-D1-C242::scFv3
Lane 4 SLT-1A-Cys5-D1::scFv3
Lane 5 SLT-1A-Cys3-D1::scFv3
Lane 6 SLT-1A-Cys2-D1::scFv3

Figure 6. Analysis of Intermolecular Disulfide Bond Based Multimerization of Cell-Targeting Molecules Comprising SLT-1A-Cys2-D1, SLT-1A-Cys6-D1, SLT-1A-Cys7-D1, SLT-1A-Cys8-D1, or SLT-1A-Cys9-D1

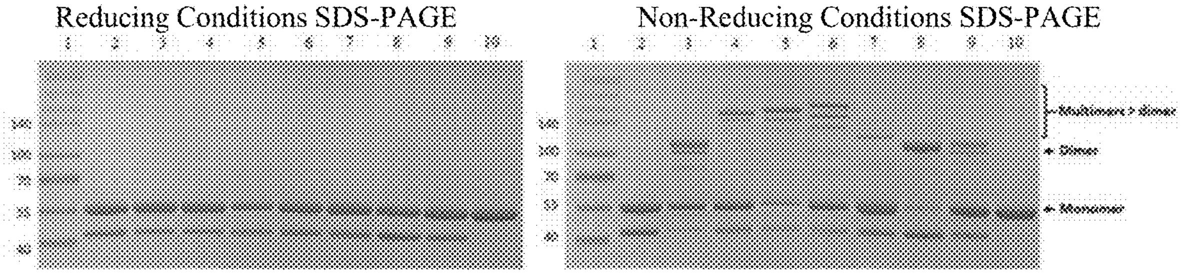

Lane 1 MW marker
Lane 2 SLT-1A-Cys2-D1::scFv2
Lane 3 SLT-1A-Cys6-D1::scFv2
Lane 4 SLT-1A-Cys8-D1::scFv2
Lane 5 SLT-1A-Cys9-D1::scFv2
Lane 6 SLT-1A-D1::linker-Cys1::scFv2
Lane 7 SLT-1A-D1::scFv2-linker-Cys1
Lane 8 SLT-1A-D1::scFv2-linker-Cys2
Lane 9 SLT-1A-Cys7-D1::scFv2
Lane 10 SLT-1A-D1::scFv2

Figure 7. Size Exclusion Chromatography of SLT-1A-Cys2-D1::scFv2 Preparation in Non-Reducing Conditions Showed the Predominant Protein Species in SLT-1A-Cys2-D1::scFv2 was Dimeric
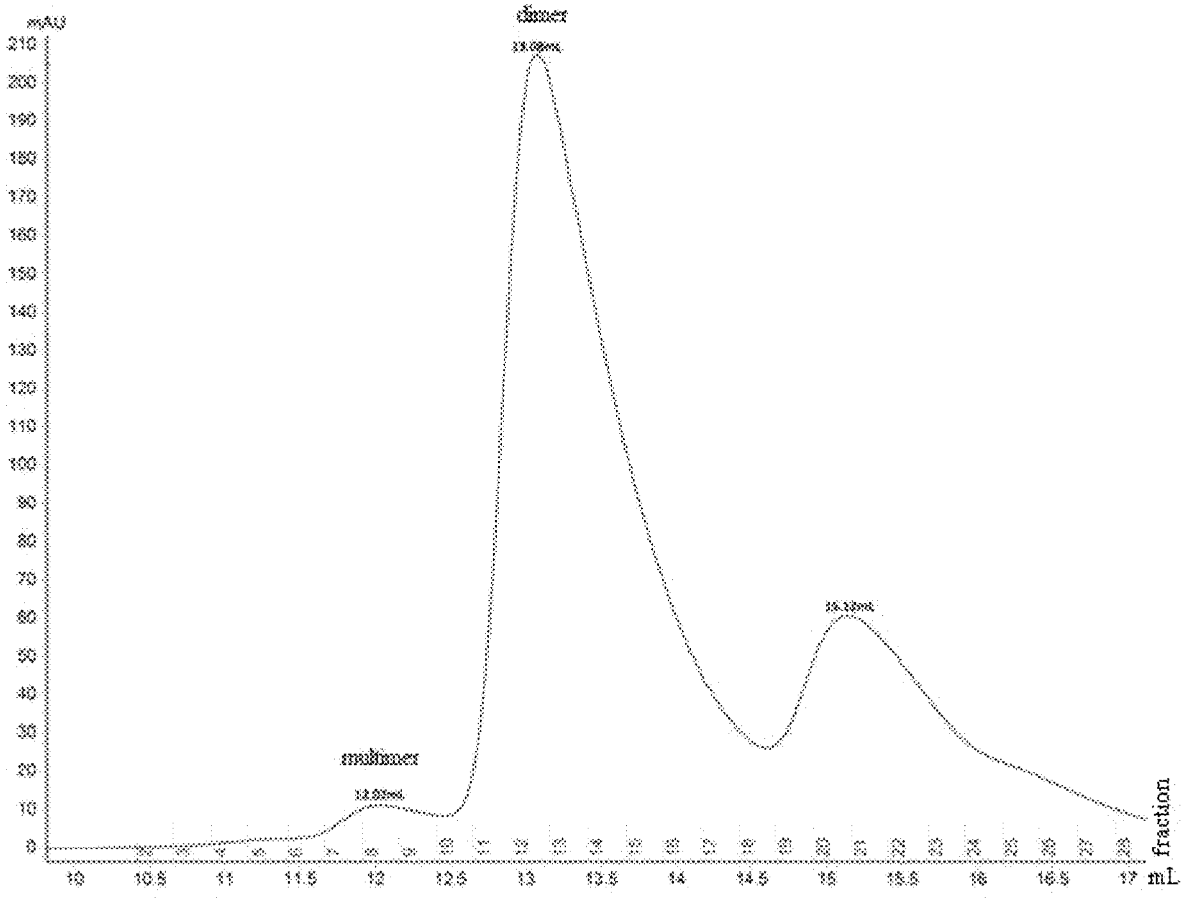

Figure 8. Size Exclusion Chromatography of SLT-1A-Cys7-D1::scFv2 Preparation in Non-Reducing Conditions Shows Various Multimeric Proteins Were Present in the Sample
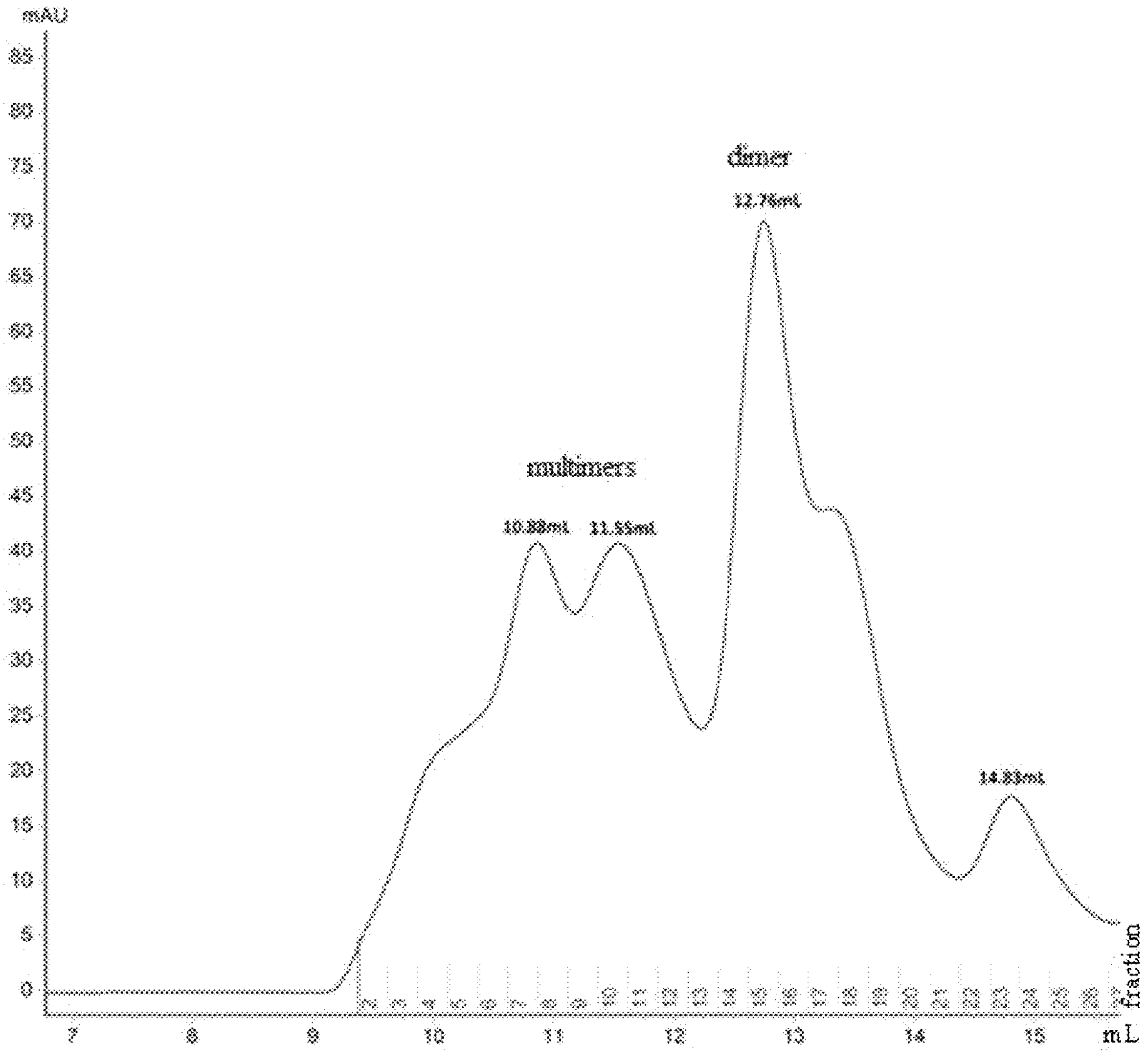

Figure 9. Binding of Exemplary, Cargo-Linked Cell-Targeting Molecules to Target-2 Positive Cells of Cell Line C
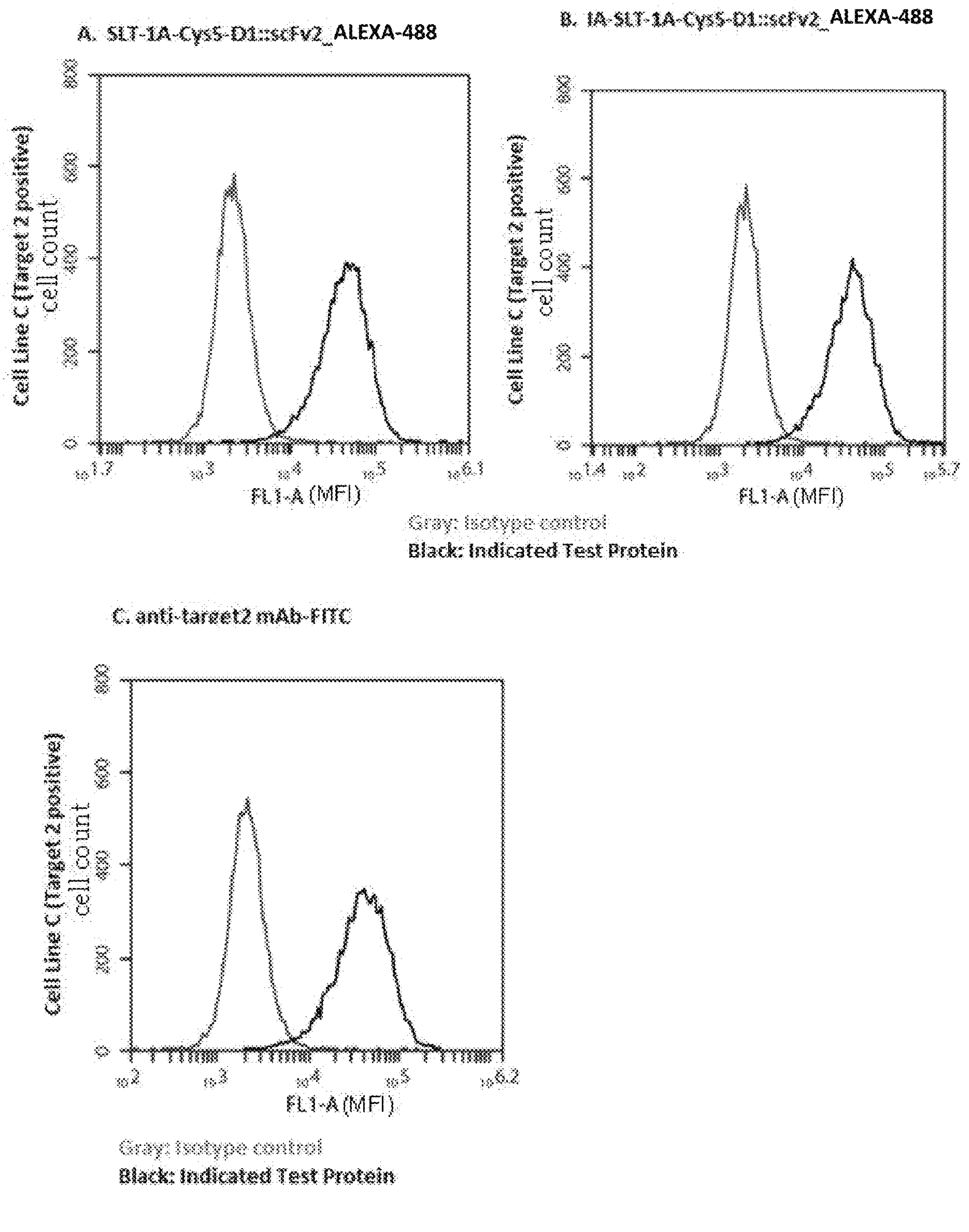

Figure 10. Binding of Exemplary, Cargo-Linked Cell-Targeting Molecules to Target-2 Positive Cells of Cell Line G
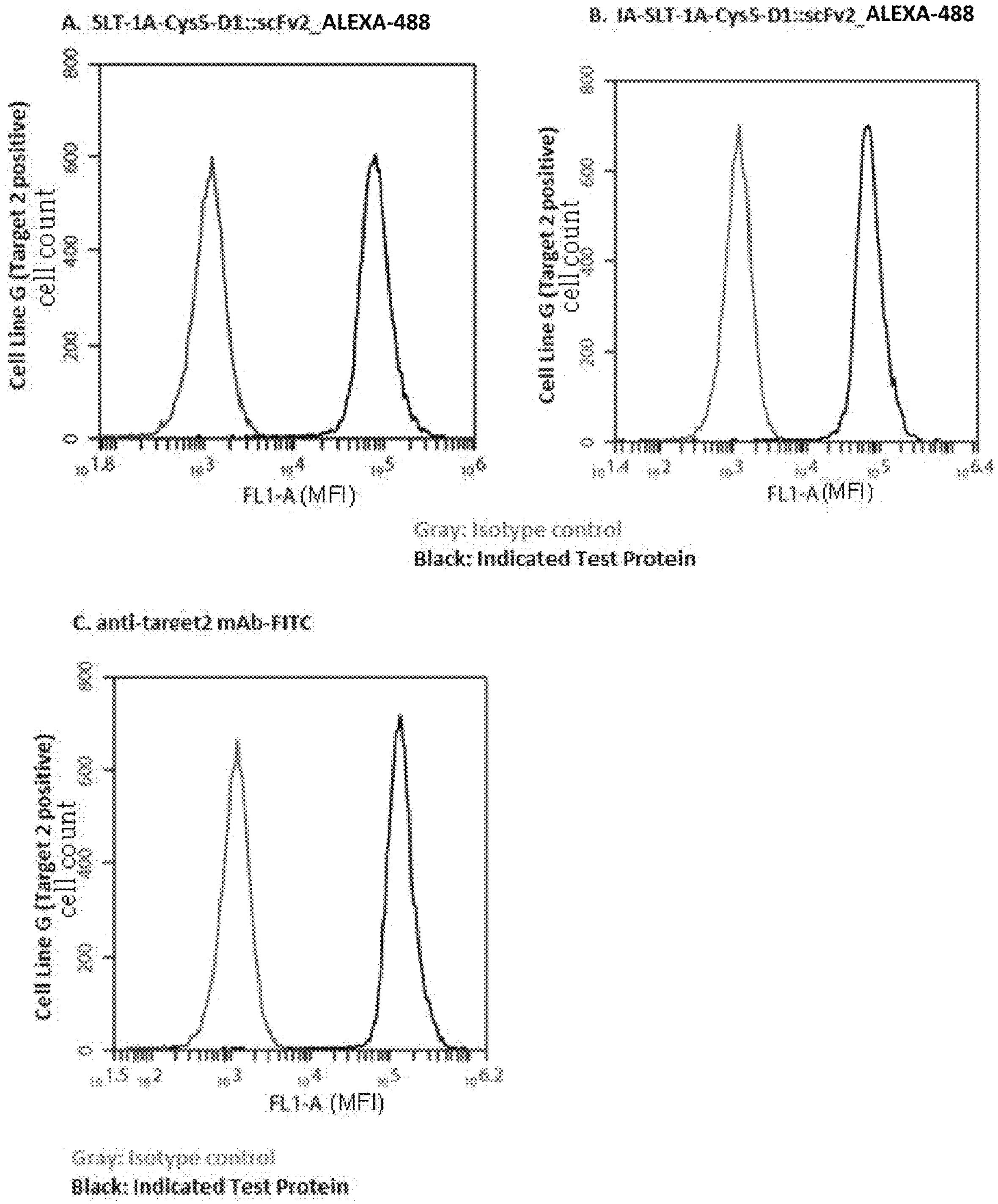

Figure 11. Lack of Binding of Exemplary, Cargo-Linked Cell-Targeting Molecules to Target-2 Negative Cells
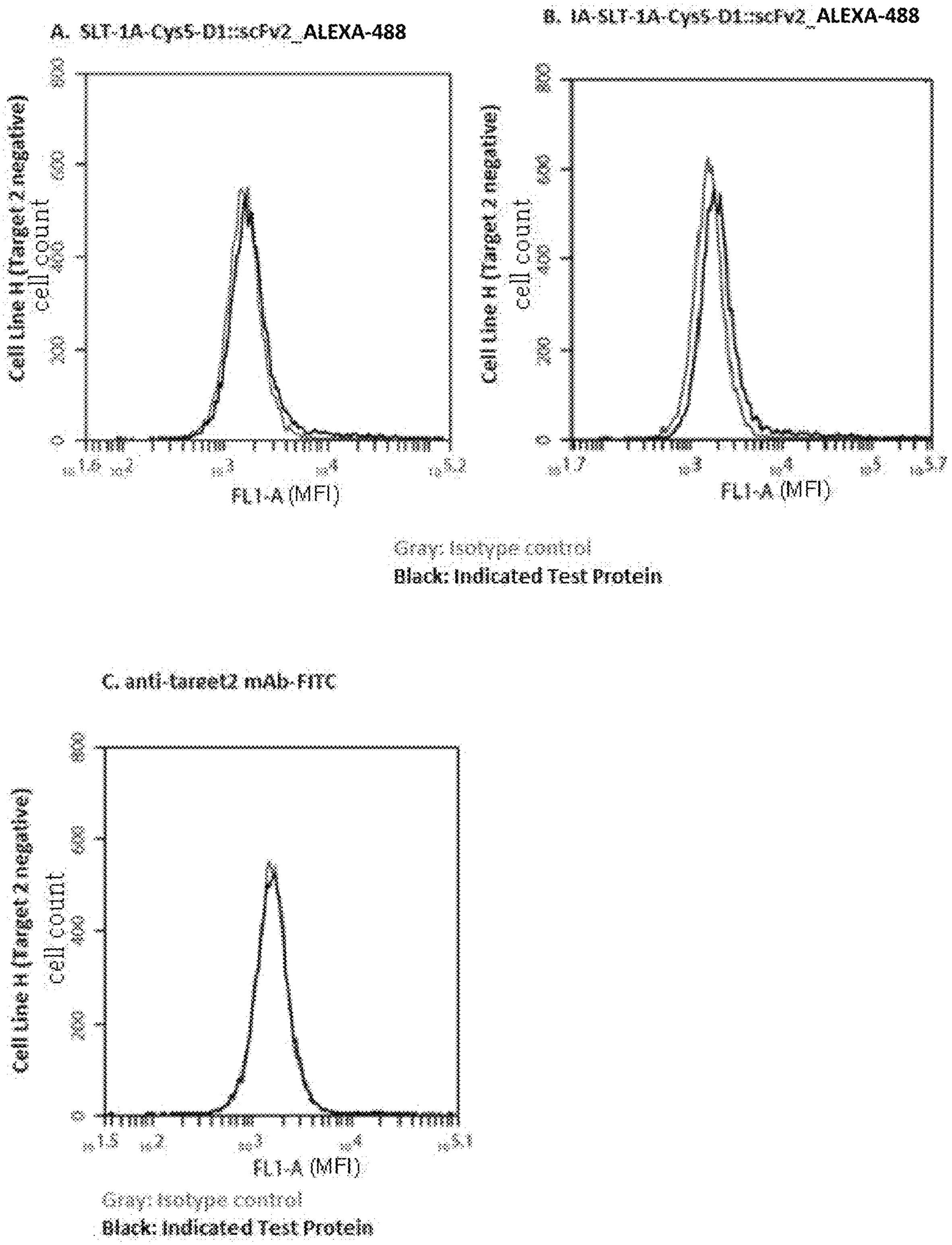

Figure 12. Fluorescence of Target-2 Positive Cells Treated with Exemplary, Cargo-Linked Cell-Targeting Molecules of the Present Invention after One Hour at 37 Degrees Celsius
A. SLT-1A-Cys5-D1::scFv2_ALEXA-555
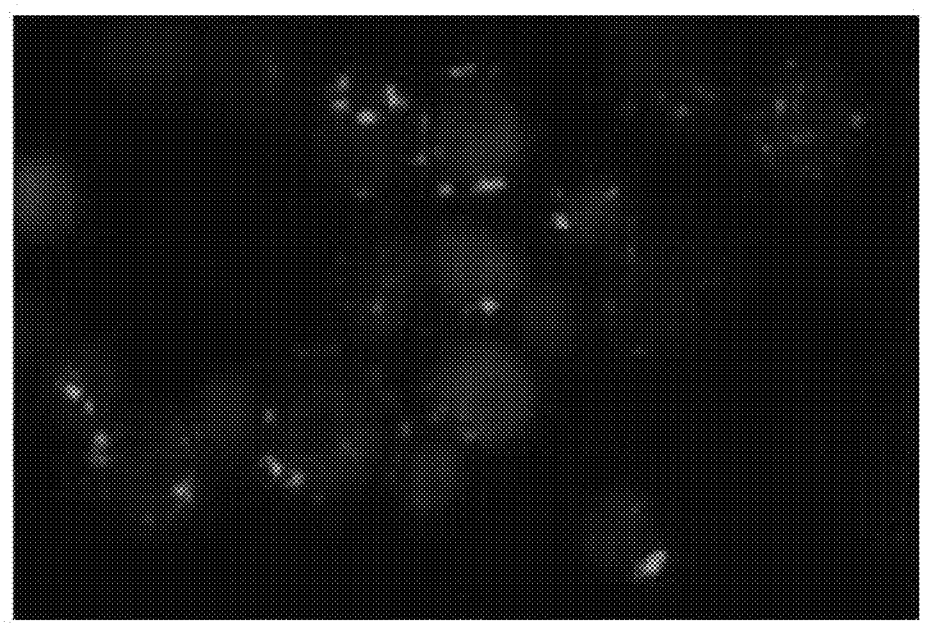
B. IA-SLT-1A-Cys5-D1::scFv2_ALEXA-555
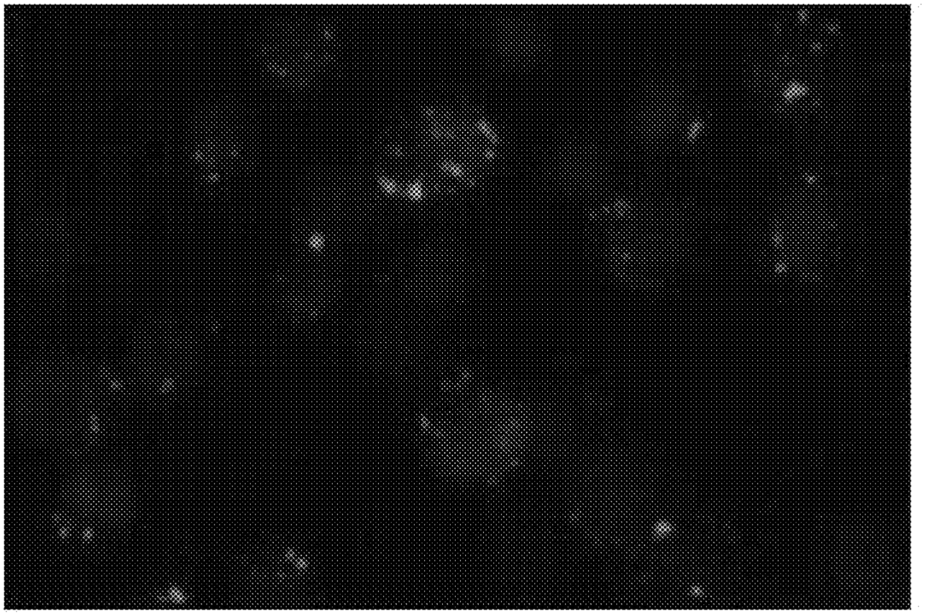
Blue: DAPI
Red: indicated dye-labeled protein Figure 13. Fluorescent Signal from Target-2 Positive Cells Treated with Exemplary, Cargo-Linked Cell-Targeting Molecules of the Present Invention after One Hour at 37 Degrees Celsius Indicates Successful Cell-Targeting and Internalization
A. SLT-1A-Cys5-D1::scFv2_ALEXA-555
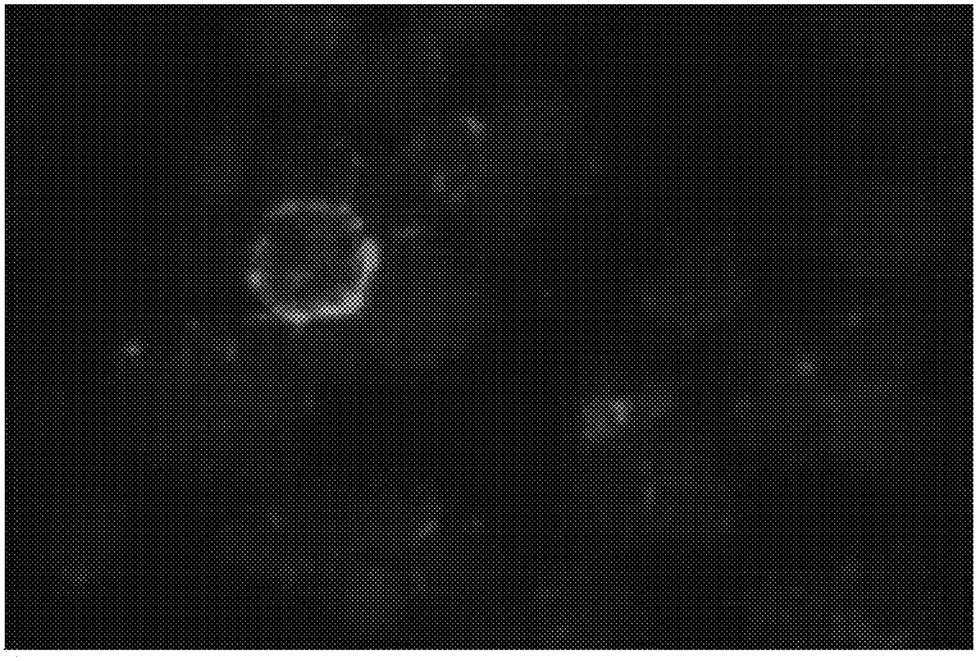
B. IA-SLT-1A-Cys5-D1::scFv2_ALEXA-555
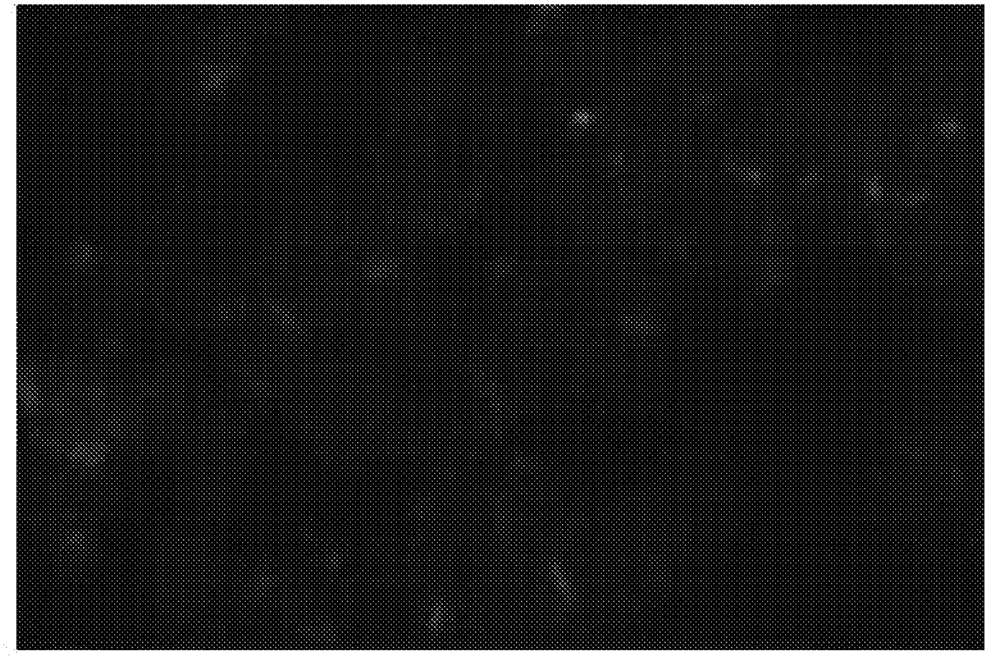
Blue: DAPI
Red: indicated dye-labeled protein

Figure 14. Lack of Fluorescent Signal from Target-2 Negative Cells Treated with Exemplary, Cargo-Linked Cell-Targeting Molecules of the Present Invention after One Hour at 37 Degrees Celsius
A. SLT-1A-Cys5-D1::scFv2_ALEXA-555
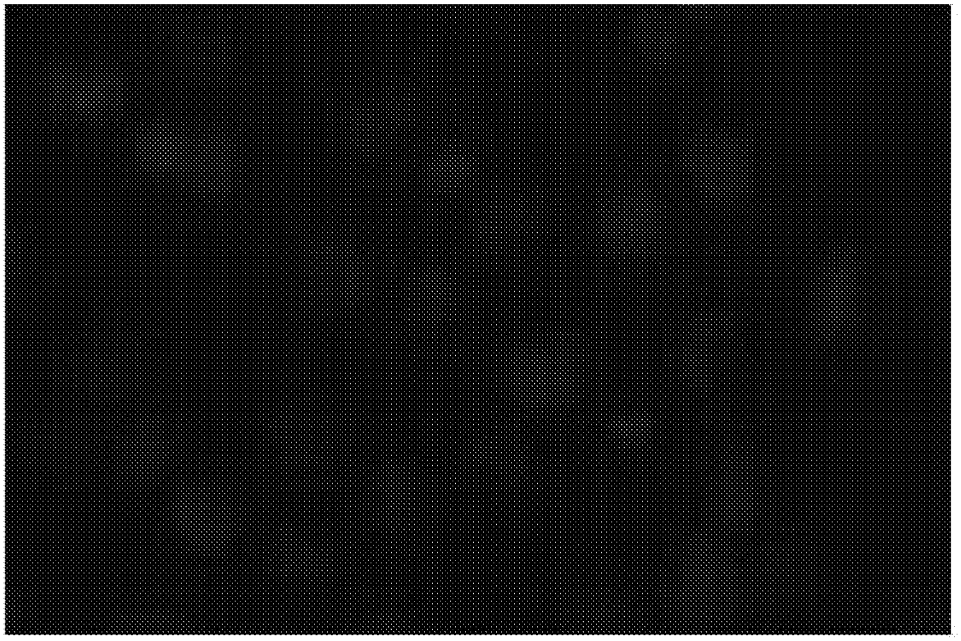
B. IA-SLT-1A-Cys5-D1::scFv2_ALEXA-555
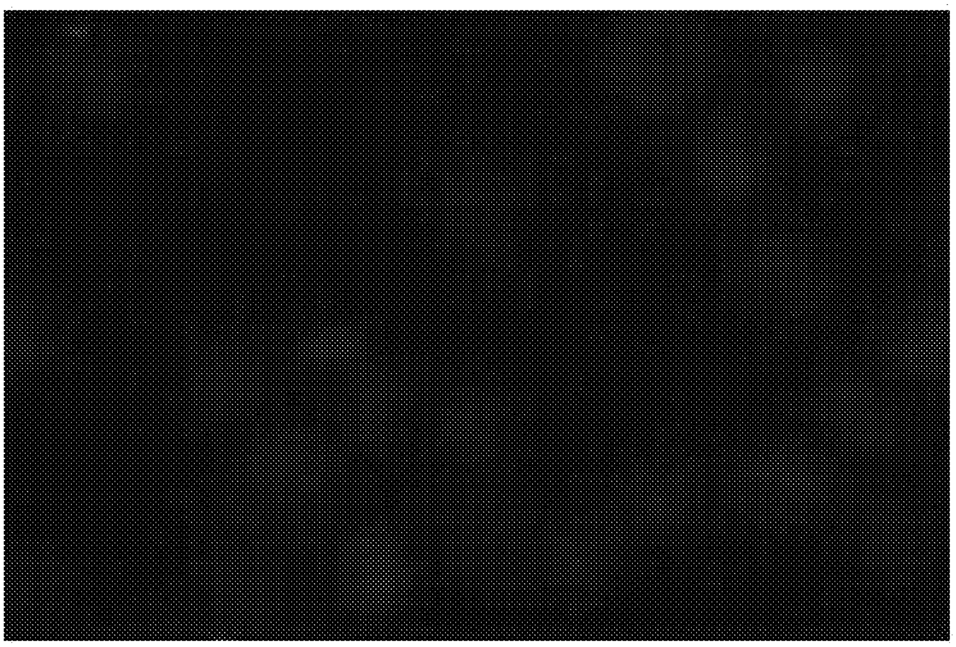
Blue: DAPI
Red: Indicated dye-labeled protein

Figure 15. SDS-PAGE Analysis of Purified Protein Samples before and after Cysteine Conjugation of an ALEXA FLUOR Dye Cargo
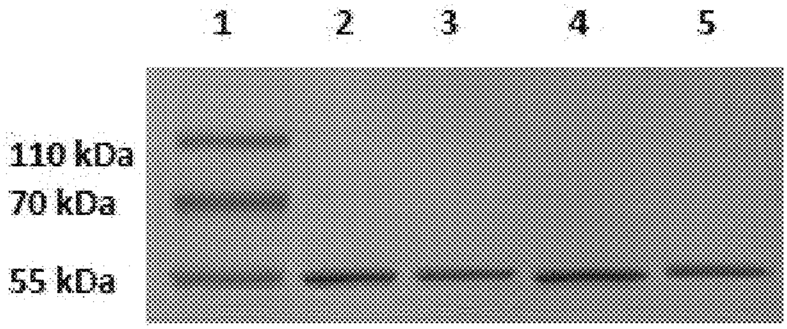
1. Molecular Weight Marker
2. SLT-1A-D1::scFv2
3. SLT-1A-Cys5-D1::scFv2_ALEXA-488
4. SLT-1A-Cys5-D1::scFv2
5. SLT-1A-Cys5-D1::scFv2_ALEXA-555

Figure 16. Cytotoxicity of Exemplary, Cargo-Linked Cell-Targeting Molecules of the Present Invention to Target Positive or Target Negative Cells
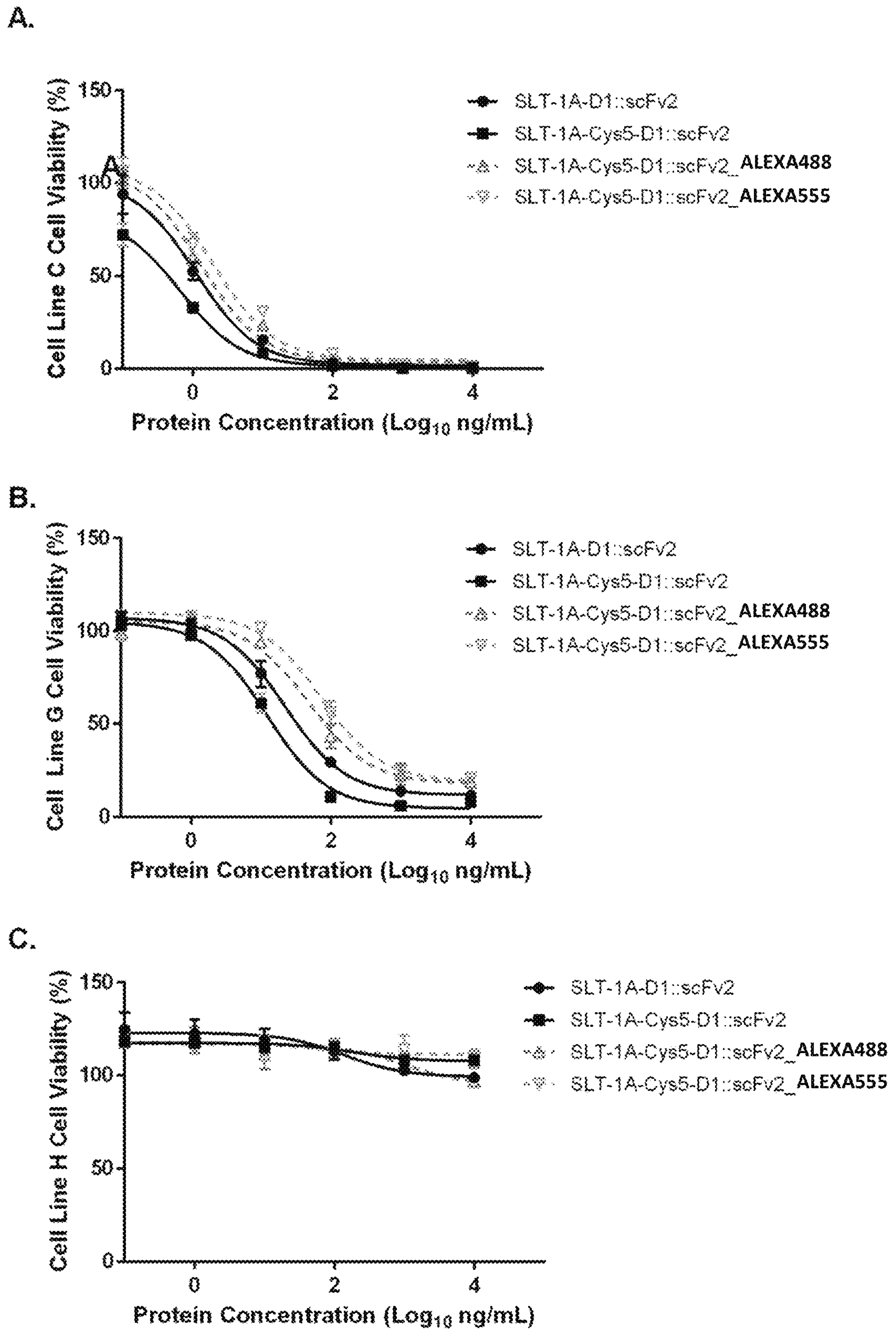

Figure 17. Cytotoxicity of Exemplary Cell-Targeting Molecules of the Present Invention to Target Positive Cells
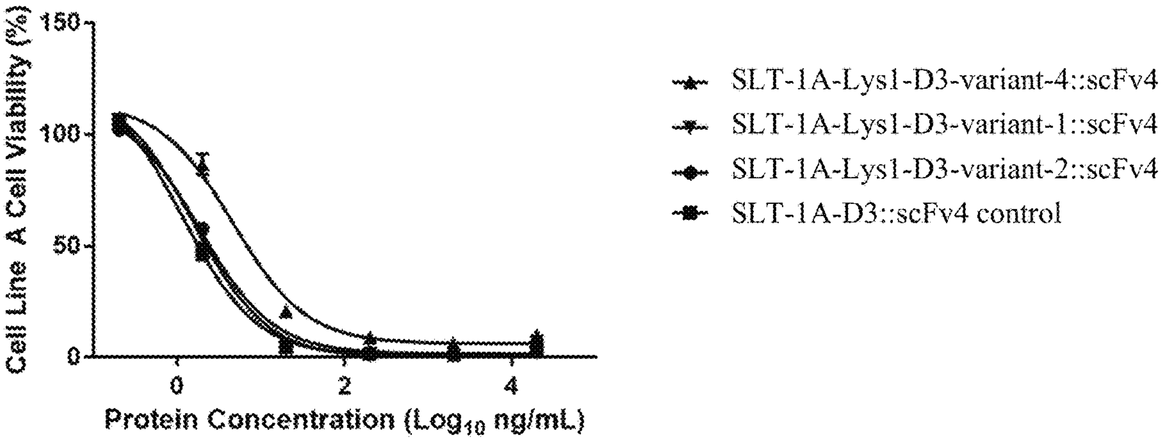
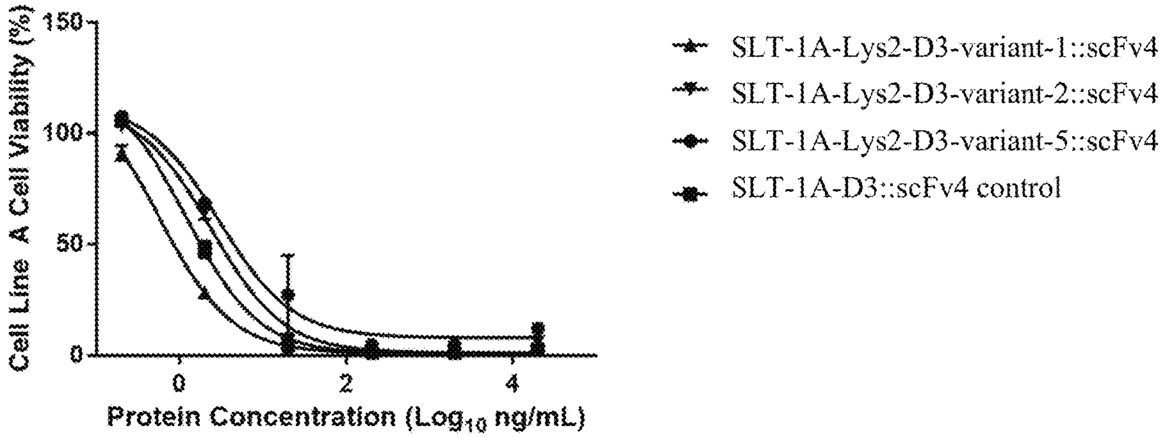
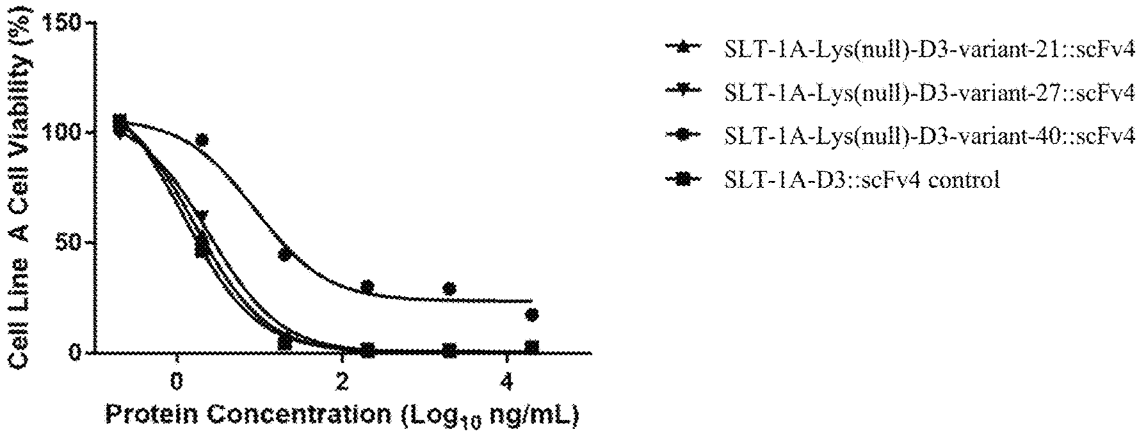

Figure 18. Cytotoxicity of Exemplary Cell-Targeting Molecules of the Present Invention to Target Negative Cells
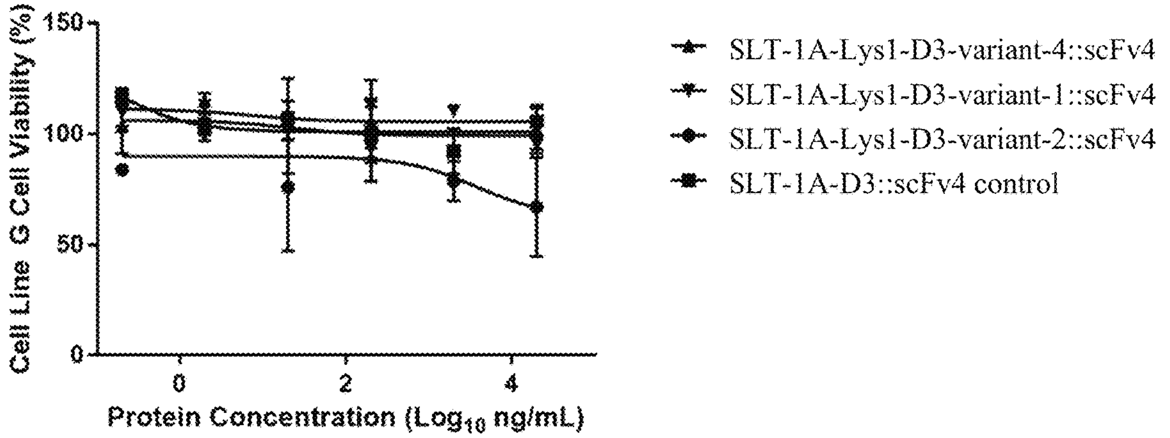
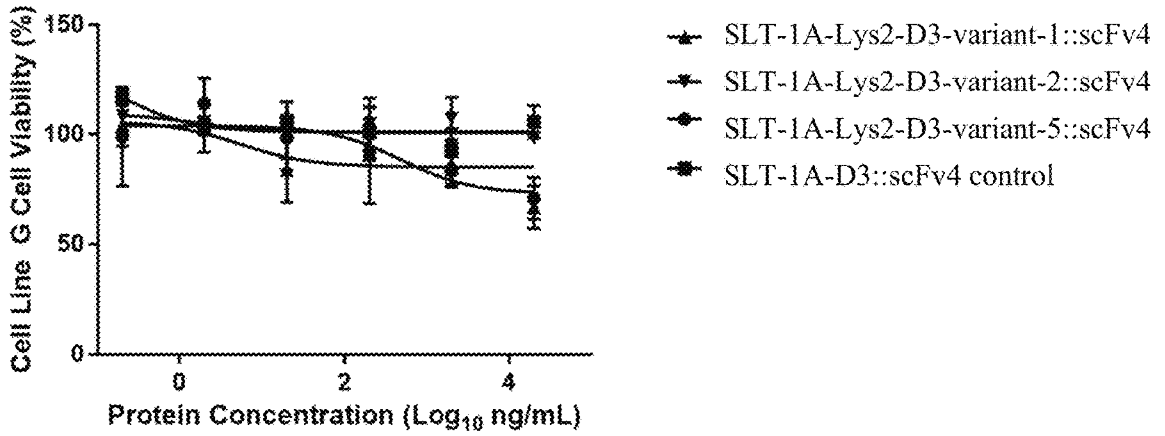
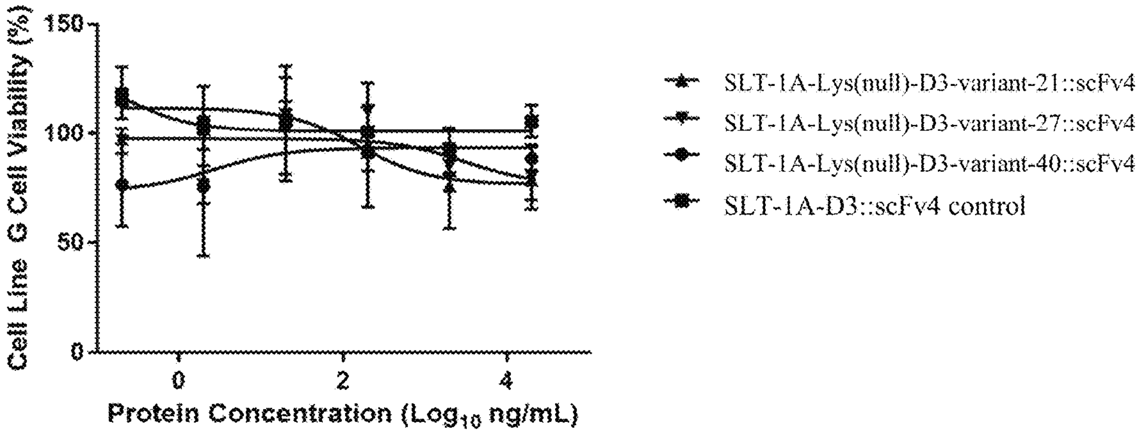

Figure 19. Cytotoxicity of Exemplary Cell-Targeting Molecules of the Present Invention to Target Positive Cells
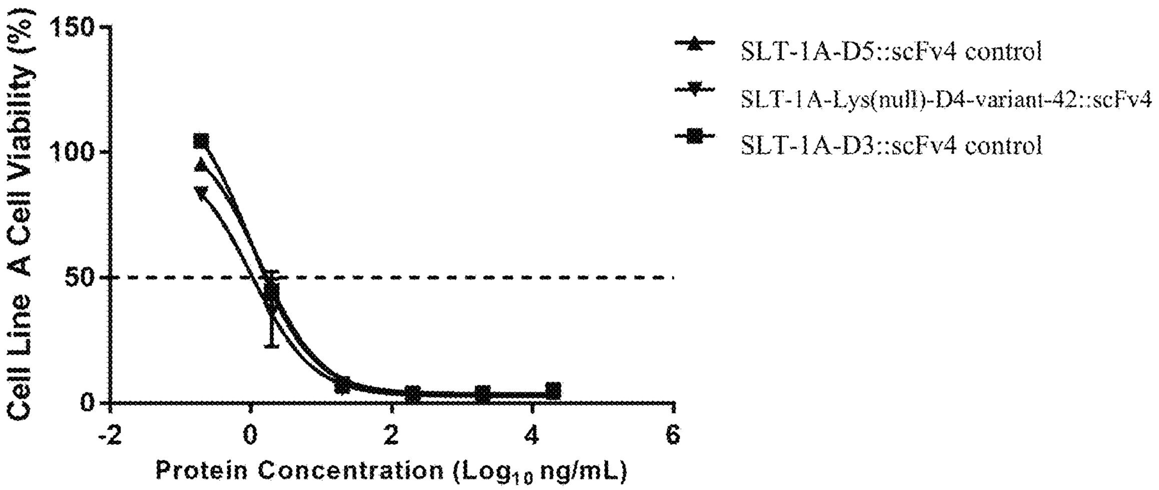
| | |
|---|---|
| SLT-1A-Lys(null)-D4-variant-42::scFv4 | SEQ ID NO:827 |
| SLT-1A-D3::scFv4 control K1/K11 | SEQ ID NO:828 |
| SLT-1A-D5::scFv4 control K1/K11 | SEQ ID NO:829 |

SHIGA TOXIN A SUBUNIT EFFECTOR POLYPEPTIDES, SHIGA TOXIN EFFECTOR SCAFFOLDS, AND CELL-TARGETING MOLECULES FOR SITE-SPECIFIC CONJUGATION

CROSS-REFERENCE TO RELATED APPLICATIONS

This application is a continuation of U.S. application Ser. No. 16/467,737, filed Jun. 7, 2019, which is a National Stage entry of International Application No. PCT/US2017/065074, filed Dec. 7, 2017, which claims benefit under 35 U.S.C. § 119(e) of U.S. Provisional Application No. 62/431,036 filed Dec. 7, 2016, the contents of each of which are incorporated herein by reference in their entireties.

INCORPORATION BY REFERENCE OF SEQUENCE LISTING

The content of the text file submitted electronically herewith is incorporated herein by reference in its entirety: A computer readable format copy of the Sequence Listing (filename: MTEM_006_02US_SeqList_ST25.txt, date created: May 4, 2021, file size: about 2.18 megabytes).

TECHNICAL FIELD

The present invention relates to cell-targeting molecules and/or components of cell-targeting molecules comprising site-specific amino acid residues for linking other molecules, such as, e.g., for covalently linking a cargo molecule for delivery by the cell-targeting molecule. Certain embodiments of the cell-targeting molecules of the present invention comprise a Shiga toxin effector polypeptide, linker, and/or immunoglobulin-type polypeptide of the present invention which is optionally conjugated to another molecule, such as, e.g., an agent that alters a property of the cell-targeting molecule and/or a cargo for delivery. The cell-targeting molecules of the present invention, and compositions thereof, have uses, e.g., for the selective delivery of cargos to target-expressing cells and as diagnostic and/or therapeutic molecules for the treatment of a variety of diseases, disorders, and conditions, which include genetic disorders, genetic predispositions, infections, cancers, tumors, growth abnormalities, and/or immune disorders.

BACKGROUND

The following includes information that may be useful in understanding the invention(s) described herein. It is not an admission that any of the information provided herein is prior art or relevant to the presently described or claimed invention(s), or that any publication or document that is specifically or implicitly referenced herein is prior art.

Shiga toxin effector polypeptides may be combined with immunoglobulin domains, ligands, and other targeting moieties to create cell-targeting molecules (see e.g., WO 2014/164693; WO 2015/113005; WO 2015/113007; WO 2015/138435; WO 2015/138452; WO 2015/191764; US20160177284; WO 2016/126950). A Shiga toxin A Subunit effector polypeptide is a polypeptide derived from a Shiga toxin A Subunit member of the Shiga toxin family that is capable of exhibiting one or more Shiga toxin functions (see e.g., Cheung M et al., *Mol Cancer* 9: 28 (2010); WO 2014/164693; WO 2015/113005; WO 2015/113007; WO 2015/191764; WO 2016/126950). Shiga toxin A Subunits are stable and can retain toxin function(s) even if mutated, truncated, and/or fused to other molecules (see e.g., WO 2014/164693; WO 2015/113005; WO 2015/113007; WO 2015/138452; WO 2015/191764; US20160177284; WO 2016/126950). Shiga toxin functions include, e.g., increasing cellular internalization, directing subcellular routing from an endosomal compartment to the cytosol via a defined series of well-characterized intracellular compartments, avoiding intracellular degradation, catalytically inactivating ribosomes, and effectuating cytostatic and/or cytotoxic effects. In addition, Shiga toxin effector polypeptides have become appreciated for having unique characteristics favorable for use in cell-internalizing molecules for targeted therapies (see e.g. WO 2014/164680; US 20150259428; WO 2016/126950).

Biological conjugates are useful formats for the development of therapeutic or diagnostic biological molecules, such as, e.g., by linking biological active agents to targeting agents, solubility-altering agents, pharmacokinetic-altering agents, immunogenicity-altering agents, and pharmacodynamic-altering agents. Biological conjugates have been shown to have novel utilities compared to an unconjugated component of the conjugate, such as, e.g., cell-type specific targeting of drugs by antibody-drug conjugates or cell-type specific targeting of toxins by immunotoxins and ligand-toxin fusions. In addition, biological conjugates having novel utilities and/or desirable improvements in characteristics may be rationally designed. Biological conjugates may be designed to have improved characteristics compared to an unconjugated component of the conjugate, such as, e.g., improvements in pharmacokinetics, pharmacodynamics, safety, tolerability, therapeutic windows, solubility, and immunogenicity.

It is desirable to have Shiga toxin effector polypeptide conjugates and cell-targeting molecules comprising Shiga toxin effector polypeptides optimized for conjugation to another agent(s) or cargo(s) in order to develop therapeutic and/or diagnostic biological molecules. For example, it is desirable to have cell-targeting molecules comprising Shiga toxin effector polypeptides conjugated to a molecular cargo(s) to form molecules capable of cell-targeted delivery of their cargo(s). Furthermore, it is desirable to have cell-targeting molecules comprising Shiga toxin effector polypeptides conjugated to a molecular cargo(s) to form molecules capable of precise intracellular delivery of their cargo(s) after following a well-defined subcellular route directed by the Shiga toxin effector polypeptide (see e.g. WO 2015/138435, WO 2015/138452, and WO 2015/191764). In addition, it is desirable to have cell-targeting molecules comprising Shiga toxin effector polypeptides conjugated to an agent such as, e.g., a solubility-altering agent, pharmacokinetic-altering agent, immunogenicity-altering agent, and/or a pharmacodynamic-altering agent.

Typically, biological molecules are conjugated to other agents or cargos using chemical reactions involving a functional group(s) of the biological molecule and a functional group of the agent or cargo, or alternatively of a linker designed to bridge between the biological molecule and the agent or cargo. However, there several problems with traditional conjugation chemistry that limit its usefulness, such as, e.g., controlling conjugation site specificity, managing conjugate stoichiometry, obtaining desirable homogeneity, low yields, batch-to-batch consistency, and cost-effectiveness (see e.g. Panowski S et al., *MAbs* 6: 34-45 (2014)). In particular, homogeneity may be key to conjugate drug manufacturing because homogenous products are more likely to perform better in the clinic because such products commonly have better pharmacokinetic and safety profiles. For example, protein conjugates generated from solvent accessible amino acid residues using traditional methods can result in heterogeneous mixtures of conjugates having varying conjugate stoichiometric ratios and different residue position attachment sites. Furthermore, an important criterion of the quality of a biological drug conjugate is homogeneity, which may be required for government approval for sale (see e.g., Kim E, Kim K, *Biomol Ther* 23: 493-509 (2015); Zhou Q, Kim J, *Anticancer Agents Med Chem* 15: 828-36 (2015)). Thus, it is desirable to control conjugation to proteinaceous biological molecules, such as, e.g., by using methods which force conjugation to a limited number of known, residue sites at a desired conjugate stoichiometry. However, even if conjugation is limited to a single product, the purification of the conjugate away from unconjugated material can be inefficient and costly.

There is a need in the art to develop Shiga toxin A Subunit scaffolds and cell-targeting molecules comprising the aforementioned for convenient, controlled, and cost-effective, site-specific conjugation of various molecules, such as, e.g., cargos for targeted delivery or molecule altering agents to improve properties of the overall molecule (e.g. therapeutic effectiveness, pharmacokinetics, immunogenicity, or therapeutic indexes after administration of the molecule to a vertebrate). It is desirable to have convenient and lower-cost methods for achieving greatly homogeneous biological conjugates of biological molecules comprising Shiga toxin A Subunit effector polypeptides, such as, e.g. cell-targeting molecules for diagnostic and/or therapeutic purposes.

SUMMARY OF THE INVENTION

The present invention provides various embodiments of Shiga toxin A Subunit effector polypeptides, Shiga toxin effector scaffolds, and cell-targeting molecules which each comprise site-specific amino acid residues for linking other molecules, such as, e.g., a cargo molecule. The present invention also provides various embodiments of Shiga toxin A Subunit effector polypeptides, Shiga toxin effector scaffolds, and cell-targeting molecules which each comprise an agent or cargo linked, either directly or indirectly, to a site-specific amino acid residues, such as, e.g., a specific cysteine or lysine residue. In addition, the present invention provides components of cell-targeting molecules comprising site specific attachment amino acid residues for linking other molecules, such as, e.g., a cargo molecule for delivery by the cell-targeting molecule or a cell-targeting molecule altering agent which confers a desirable property to the cell-targeting molecule after administration to a mammal.

The present invention provides various embodiments of Shiga toxin A Subunit polypeptides having a unique residue and/or one or more ectopic amino acid residues wherein each polypeptide is capable of exhibiting one or more Shiga toxin A Subunit effector functions, such as, e.g., promoting cellular internalization, efficient subcellular routing, catalytic activity, and cytotoxicity. The present invention provides various embodiments of Shiga toxin A Subunit polypeptides having one or more mutations relative to a naturally occurring Shiga toxin which creates a unique and/or ectopic amino acid residue(s) wherein each polypeptide is capable of exhibiting one or more Shiga toxin effector functions.

The linking of cell-targeting binding regions to Shiga toxin A Subunit-derived polypeptides enables the engineering of cell-targeting molecules that can take advantage of the unique and/or ectopic amino acid residue(s) as attachment point(s) for linking other molecules, such as, e.g., molecular cargos for delivery and/or agents which alter the properties of the cell-targeting molecule. Therefore, certain cell-targeting molecules of the present invention, and compositions thereof, may be used to selectively deliver cargo(s) to a target-expressing cell type(s) in the presence of one or more other cell types. In addition, certain cell-targeting molecules of the present invention, and compositions thereof, may be used to selectively kill a target-expressing cell in the presence of one or more other cell types. For example, certain cell-targeting molecules of the present invention may be potently cytotoxic to target-expressing cells via their abilities to efficiently deliver into the interior of a target-expressing cell a catalytically active, Shiga toxin effector polypeptide(s) that is able to effectively route to the cytosol.

Certain embodiments of the present invention are Shiga toxin A Subunit effector polypeptides comprising one or more mutations relative to wild-type, Shiga toxins creating a unique site and/or position-ectopic amino acid residue(s). The unique sites and/or ectopic amino acid residues of the Shiga toxin A Subunit effector polypeptides of the present invention have uses, e.g., for the controlled, site-specific attachment, either directly or indirectly, of other molecules such as linkers, cell-targeting moieties, peptides, nucleic acids, proteins, protein-nucleic acid complexes, cytotoxic agents, solubility-altering agents, pharmacokinetic-altering agents, immunogenicity-altering agents, and pharmacodynamic-altering agents. In certain embodiments, the Shiga toxin A Subunit effector polypeptide of the present invention is capable of exhibiting one or more Shiga toxin A Subunit effector functions, such as, e.g., promoting cellular internalization, efficient subcellular routing, catalytic activity, and cytotoxicity. In certain embodiments, the Shiga toxin A Subunit effector polypeptide of the present invention is conjugated to another molecule via the unique site and/or ectopic amino acid residue of the Shiga toxin effector polypeptide. The present invention also provides cell-targeting molecules comprising a Shiga toxin effector polypeptide of the present invention optionally conjugated to another molecule via the unique site and/or ectopic amino acid residue of the Shiga toxin effector polypeptide. In addition, the present invention provides various cell-targeting molecules, and compositions thereof, that comprise such Shiga toxin A Subunit polypeptides, and wherein each molecule is capable of delivering a Shiga toxin A Subunit effector polypeptide to a target cell and the Shiga toxin A Subunit is capable of entering the target cell.

Certain embodiments of the present invention are Shiga toxin A Subunit effector polypeptide scaffolds each comprising at least one Shiga toxin A Subunit effector polypeptide and a linker wherein the scaffold comprises one unique amino acid residue. The unique amino acid residues of the Shiga toxin A Subunit effector polypeptide scaffolds of the present invention have uses, e.g., for the controlled, site-specific attachment, either directly or indirectly, of other molecules such as cell-targeting moieties, peptides, nucleic acids, proteins, protein-nucleic acid complexes, cytotoxic agents, solubility-altering agents, pharmacokinetic-altering agents, immunogenicity-altering agents, and pharmacodynamic-altering agents. In certain embodiments, the Shiga toxin A Subunit effector polypeptide scaffold of the present invention is capable of exhibiting one or more Shiga toxin A Subunit effector functions, such as, e.g., promoting cellular internalization, efficient subcellular routing, catalytic activity, and cytotoxicity. In certain embodiments, the Shiga toxin A Subunit effector polypeptide scaffold of the present invention is conjugated to another molecule via the unique amino acid residue of the Shiga toxin effector polypeptide scaffold. The present invention also provides cell-targeting molecules comprising a Shiga toxin effector polypeptide scaffold of the present invention optionally conjugated to another molecule at the site of the unique amino acid residue of the Shiga toxin effector polypeptide scaffold. In addition, the present invention provides various cell-targeting molecules, and compositions thereof, that comprise such Shiga toxin effector polypeptide scaffolds, and wherein each molecule is capable of delivering a Shiga toxin A Subunit effector polypeptide to a target cell and the Shiga toxin A Subunit is capable of entering the target cell.

Certain embodiments of the present invention are components for cell-targeting molecules, such as, e.g., a linker or cell-targeting binding region, which each comprise a unique site and/or ectopically-positioned amino acid reside for the controlled, site-specific attachment, either directly or indirectly, of other molecules. Certain further embodiments are cell-targeting binding regions (e.g. immunoglobulin-derived polypeptides), each comprising an amino acid residue(s) with a functional group for site-specific attachment, either directly or indirectly, of other molecules such as linkers, cell-targeting moieties, peptides, nucleic acids, proteins, protein-nucleic acid complexes, cytotoxic agents, solubility-altering agents, pharmacokinetic-altering agents, immunogenicity-altering agents, and pharmacodynamic-altering agents. Certain other embodiments of the present invention are linkers comprising site-engineered, functional group(s) for site specific attachment of other molecules. The present invention also provides cell-targeting molecules comprising such a component, e.g. a cell-targeting binding region and/or linker of the present invention optionally linked to another molecule.

Certain embodiments of the cell-targeting molecules of the present invention comprise a Shiga toxin effector polypeptide, Shiga toxin effector scaffold, linker, and/or immunoglobulin-type polypeptide of the present invention which is optionally conjugated to another molecule, such as, e.g., an agent that alters a property of the cell-targeting molecule and/or a cargo for delivery. For certain further embodiments, the Shiga toxin A Subunit component of the cell-targeting molecule is capable of exhibiting one or more Shiga toxin A Subunit effector functions, such as, e.g., promoting cellular internalization, efficient subcellular routing, catalytic activity, and cytotoxicity. The cell-targeting molecules of the present invention, and compositions thereof, have uses, e.g., for the selective delivery of cargos to target-expressing cells and as diagnostic and/or therapeutic molecules for the treatment of a variety of diseases, disorders, and conditions, which include genetic disorders, genetic predispositions, infections, cancers, tumors, growth abnormalities, and/or immune disorders.

Embodiment Set #1—Shiga Toxin Effector Polypeptides

In certain embodiments, the Shiga toxin effector polypeptide of the present invention is derived from the A Subunit of at least one member of the Shiga toxin family and comprises a unique amino acid residue relative to all the other amino acid residues in the polypeptide. In certain further embodiments, the Shiga toxin effector polypeptide is capable of exhibiting one or more Shiga toxin effector functions. For certain further embodiments, the Shiga toxin effector polypeptide is capable of exhibiting a significant level of one or more Shiga toxin effector functions selected from promoting cellular internalization, directing subcellular routing to the cytosol after cell entry, catalytic inactivation of ribosomes, and cytotoxicity. In certain further embodiments, the unique amino acid residue is ectopic. In certain further embodiments, the unique amino acid residue is a cysteine, histidine, lysine, or unnatural amino acid residue. In certain further embodiments, the unique amino acid residue is capable of being incorporated into the Shiga toxin effector polypeptide via a nucleic acid translation process. In certain further embodiments, the Shiga toxin effector polypeptide is covalently linked via the unique amino acid residue's functional group to a heterologous molecule, such as, e.g., a cell-targeting binding region, linker, additional exogenous material, cargo, cell-targeting altering agent. In certain further embodiments, the heterologous molecule is selected from the group consisting of: antibiotic, antigen, antigenic material, cytotoxic agent, radionucleide, cell-targeting molecule altering agent, detection-promoting agent, dye, T-cell epitope, fluorophore, immunogen, immunogenic material, enzyme, zymoxin, lipid, polymer, polyethylene glycol, serum albumin binding agent, small molecule chemotherapeutic agent, prodrug, peptide, protein, nucleic acid, and/or protein-nucleic acid complex.

In certain embodiments, the Shiga toxin effector polypeptide of the present invention comprises one or more amino acid substitutions relative to a wild-type Shiga toxin A Subunit having substantial sequence identity; wherein the totality of the amino acid substitution results in the presence of a unique amino acid residue in the Shiga toxin effector polypeptide compared to all other residues in the Shiga toxin effector polypeptide; and wherein the Shiga toxin effector polypeptide is capable of exhibiting one or more Shiga toxin effector functions. The term "substantial sequence identity" means having at least about 85%, 90%, 95%, 98%, 99% or more identity (typically having an identity of 92-99%) over an aligned polypeptide sequence of the same size or when compared to an aligned sequence in which the alignment is done by a computer homology program known in the art. In certain further embodiments, the unique amino acid residue is one of the one or more substituted amino acids and may be considered position ectopic. Position-ectopic means the position of the unique amino acid is not the type of amino acid natively found in that position in a closely aligned wild-type Shiga toxin A Subunit, or fragment thereof, when aligned with the entire length of the Shiga toxin effector polypeptide of the present invention. In certain other embodiments, the unique amino acid is a natively positioned amino acid relative to a wild-type Shiga toxin A Subunit having substantial sequence identity with the Shiga toxin effector polypeptide. Its uniqueness may be due to the one or more amino acid substitutions removing one or more other amino acids of the same type.

In certain embodiments, the Shiga toxin effector polypeptide of the present invention is capable of exhibiting one or more Shiga toxin effector functions selected from the group consisting of: directing intracellular routing to the Golgi apparatus of a cell in which the polypeptide is present, directing intracellular routing to the endoplasmic reticulum of a cell in which the polypeptide is present, directing intracellular routing to the cytosol of a cell in which the polypeptide is present, directing intracellular routing with a cargo linked directly or indirectly to the polypeptide, inhibiting a ribosome function, enzymatically inactivating a ribosome, and cytotoxicity. In certain further embodiments, the Shiga toxin effector polypeptide is capable of exhibiting a ribosome inhibition activity with an $IC_{50}$ value of 10,000 picomolar or less.

In certain further embodiments, the unique amino acid residue is a non-natural amino acid residue.

In certain further embodiments, the unique amino acid residue is capable of being incorporated in the Shiga toxin effector polypeptide via polynucleotide translation, such as via the action of a ribosome in vitro or via the action of a ribosome in a living cell, e.g. a host cell used for protein production.

In certain further embodiments, the unique amino acid residue is positioned internally in the Shiga toxin effector polypeptide (e.g. an internally positioned amino residue cannot be a terminal residue of a polypeptide, such as an amino acid residue at a polypeptide terminus having a free, primary amine group or carboxyl group). Instead, an internal amino acid residue of a polypeptide has both an amino group and a carboxy group participating in peptide bonds with other amino acid residues.

In certain further embodiments, the unique amino acid residue is selected from the group consisting of: cysteine, histidine, lysine, selenocysteine, and pyrroline-carboxy-lysine.

In certain further embodiments, the Shiga toxin effector polypeptide of the present invention comprises or consists essentially of any one of SEQ ID NOs: 5-232.

In certain further embodiments, the unique amino acid residue is covalently linked via its functional group to a heterologous molecule, such as, e.g., an antibiotic, antigen, antigenic material, cytotoxic agent, radionucleide, cell-targeting molecule altering agent, detection-promoting agent, dye, T-cell epitope, fluorophore, immunogen, immunogenic material, enzyme, zymoxin, lipid, polymer, polyethylene glycol, serum albumin binding agent, small molecule chemotherapeutic agent, prodrug, peptide, protein, nucleic acid, and/or protein-nucleic acid complex.

In certain further embodiments, the Shiga toxin effector polypeptide of the present invention comprises one or more amino acid substitutions, in relation to a wild-type Shiga toxin A Subunit having substantial sequence identity with the Shiga toxin effector polypeptide, which results in a position-ectopic amino acid residue suitable for chemical conjugation via a chemical reactive group and wherein the Shiga toxin effector polypeptide is capable of exhibiting one or more Shiga toxin effector functions.

In certain embodiments, the Shiga toxin effector polypeptide of the present invention comprises one or more amino acid substitutions relative to a wild-type Shiga toxin A Subunit having substantial sequence identity; wherein the one or more amino acid substitutions results in a position-ectopic amino acid residue available for conjugation; and wherein the Shiga toxin effector polypeptide is capable of exhibiting one or more Shiga toxin effector functions. In certain further embodiments, the Shiga toxin effector polypeptide of the present invention is capable of exhibiting one or more Shiga toxin effector functions is selected from the group consisting of: directing intracellular routing to the Golgi apparatus of a cell in which the polypeptide is present, directing intracellular routing to the endoplasmic reticulum of a cell in which the polypeptide is present, directing intracellular routing to the cytosol of a cell in which the polypeptide is present, directing intracellular routing with a cargo linked directly or indirectly to the polypeptide, inhibiting a ribosome function, enzymatically inactivating a ribosome, and cytotoxicity. In certain further embodiments, the Shiga toxin effector polypeptide is capable of exhibiting a ribosome inhibition activity with an $IC_{50}$ value of 10,000 picomolar or less.

In certain further embodiments, the position-ectopic amino acid residue is a non-natural amino acid residue.

In certain further embodiments, the position-ectopic amino acid residue is capable of being incorporated in the Shiga toxin effector polypeptide via polynucleotide translation, such as via the action of a ribosome in vitro or via the action of a ribosome in a living cell.

In certain further embodiments, the position-ectopic amino acid residue is positioned internally in the Shiga toxin effector polypeptide.

In certain further embodiments, the position-ectopic amino acid residue is selected from the group consisting of: cysteine, histidine, lysine, selenocysteine, and pyrroline-carboxy-lysine.

In certain further embodiments, the Shiga toxin effector polypeptide of the present invention comprises or consists essentially of any one of SEQ ID NOs: 5-124.

In certain further embodiments, the position-ectopic amino acid residue is covalently linked via its functional group to a heterologous molecule, such as, e.g., an antibiotic, antigen, antigenic material, cytotoxic agent, radionucleide, cell-targeting molecule altering agent, detection-promoting agent, dye, T-cell epitope, fluorophore, immunogen, immunogenic material, enzyme, zymoxin, lipid, polymer, polyethylene glycol, serum albumin binding agent, small molecule chemotherapeutic agent, prodrug, peptide, protein, nucleic acid, and/or protein-nucleic acid complex.

In certain further embodiments, the position-ectopic amino acid residue is covalently linked via its functional group to a heterologous molecule, such as, e.g., an antibiotic, antigen, antigenic material, cytotoxic agent, radionucleide, cell-targeting molecule altering agent, detection-promoting agent, dye, T-cell epitope, fluorophore, immunogen, immunogenic material, enzyme, zymoxin, lipid, polymer, polyethylene glycol, serum albumin binding agent, small molecule chemotherapeutic agent, prodrug, peptide, protein, nucleic acid, and/or protein-nucleic acid complex.

In certain embodiments, the Shiga toxin effector polypeptide of the present invention comprises or consists essentially of any one of SEQ ID NOs: 5-84, 830, 832, and 1109-1140.

In certain embodiments, the Shiga toxin effector polypeptide of the present invention (1) is a polypeptide derived from an A Subunit of a member of the Shiga Toxin Family and (2) comprises an amino acid residue having a functional group covalently linked via the functional group to a heterologous molecule, which is heterologous to Shiga toxins. For certain further embodiments, the Shiga toxin effector polypeptide is capable of exhibiting a Shiga toxin effector function. In certain further embodiments, the amino acid residue is a cysteine, histidine, lysine, selenocysteine, and pyrroline-carboxy-lysine. In certain further embodiments, the amino acid residue is ectopic to a wild-type Shiga toxin A Subunit—meaning that amino acid residue is not naturally found at that position in a wild-type Shiga toxin. In certain further embodiments, the amino acid residue is non-natural—meaning that amino acid is not one of the twenty common amino acids. In certain further embodiments, the amino acid residue is capable of being incorporated in the Shiga toxin effector polypeptide via nucleic acid translation. In certain further embodiments, the Shiga toxin effector polypeptide comprises or consists essentially of the polypeptide shown in any one of SEQ ID NOs: 5-84, 830, 832, and 1109-1140. For certain further embodiments, the Shiga toxin effector polypeptide is capable of exhibiting significant intracellular routing from an endosomal compartment to a Golgi, endoplasmic reticulum, and/or cytosolic compartment. In certain further embodiments, the Shiga toxin effector polypeptide is capable of exhibiting a ribosome inhibition activity with an $IC_{50}$ value of 10,000 picomolar or less and/or significant level of Shiga toxin catalytic activity. In certain further embodiments, the heterologous molecule is selected from the group consisting of: peptide, protein, nucleic acid, protein-nucleic acid complex, cytotoxic agent, antibiotic, and detection-promoting agent. For certain further embodiments, the heterologous molecule is capable of specifically binding at least one extracellular target biomolecule physically coupled to the surface of a cell. In certain further embodiments, the heterologous molecule comprises a cell-targeting polypeptide. In certain further embodiments, the cell-targeting polypeptide comprises an immunoglobulin-type binding region. In certain further embodiments, the immunoglobulin-type binding region comprises a polypeptide selected from the group consisting of: an autonomous VH domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), VNAR fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. For certain further embodiments, the heterologous molecule is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB 1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain further embodiments, the Shiga toxin effector polypeptide comprises a carboxy-terminal endoplasmic reticulum retention/retrieval signal motif of a member of the KDEL family ("KDEL" disclosed as SEQ ID NO:1142). In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the Shiga toxin effector polypeptide to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, administration of the Shiga toxin effector polypeptide of the present invention to a biomolecule target-expressing cell, the Shiga toxin effector polypeptide is capable of causing death of the cell, i.e. killing the cell. In certain further embodiments, the Shiga toxin effector polypeptide comprises a mutation relative to a naturally occurring A Subunit of a member of the Shiga toxin family that changes the enzymatic activity of the Shiga toxin effector polypeptide, the mutation selected from at least one amino acid residue deletion, insertion, or substitution, such as, e.g., A231E, N75A, Y77S, Y114S, E167D, R170A, R176K and/or W203A in SEQ ID NO:1, SEQ ID NO:2, SEQ ID NO:3, or SEQ ID NO:4. In certain further embodiments, the mutation is selected from at least one amino acid residue deletion, insertion, or substitution that reduces or eliminates catalytic activity but retains at least one other Shiga toxin effector function, such as, e.g., inducing cellular internalization and/or directing subcellular routing. In certain further embodiments, the mutation reduces or eliminates cytotoxicity of the Shiga toxin effecter polypeptide.

In certain embodiments, the Shiga toxin effector polypeptide of the present invention (1) is a polypeptide derived from an A Subunit of a member of the Shiga Toxin Family and (2) comprises an ectopic amino acid residue having a functional group suitable for chemical conjugation via the functional group to a heterologous molecule, which is heterologous to Shiga toxins; and wherein the Shiga toxin effector polypeptide is capable of exhibiting a Shiga toxin effector function. In certain further embodiments, the ectopic amino acid residue is a basic and/or strongly nucleophilic amino acid residue, and optionally a cysteine, histidine, lysine, selenocysteine, or pyrroline-carboxy-lysine. In certain further embodiments, the ectopic amino acid residue is non-natural—meaning that amino acid is not one of the twenty common amino acids. In certain further embodiments, the ectopic amino acid residue is capable of being incorporated in the Shiga toxin effector polypeptide via nucleic acid translation. In certain further embodiments, the Shiga toxin effector polypeptide comprises or consists essentially of the polypeptide shown in any one of SEQ ID NOs: 5-84, 830, 832, and 1109-1140. For certain further embodiments, the Shiga toxin effector polypeptide is capable of exhibiting significant intracellular routing from an endosomal compartment to a Golgi, endoplasmic reticulum, and/or cytosolic compartment. For certain further embodiments, the Shiga toxin effector polypeptide is capable of exhibiting a ribosome inhibition activity with an $IC_{50}$ value of 10,000 picomolar or less and/or significant level of Shiga toxin catalytic activity. In certain further embodiments, the Shiga toxin effector polypeptide is linked to a heterologous molecule via the ectopic amino acid residue. In certain further embodiments, the heterologous molecule is selected from the group consisting of: peptide, protein, nucleic acid, protein-nucleic acid complex, cytotoxic agent, antibiotic, and detection-promoting agent. For certain further embodiments, the heterologous molecule is capable of specifically binding at least one extracellular target biomolecule physically coupled to the surface of a cell. In certain further embodiments, the heterologous molecule comprises a cell-targeting polypeptide. In certain further embodiments, the cell-targeting polypeptide comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. For certain further embodiments, the heterologous molecule is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain further embodiments, the Shiga toxin effector polypeptide comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the Shiga toxin effector polypeptide to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain embodiments of the Shiga toxin effector polypeptide of the present invention, administration of the Shiga toxin effector polypeptide to a target-expressing cell, the cell-targeting molecule is capable of causing death of the cell, i.e. killing the cell. In certain further embodiments, the Shiga toxin effector polypeptide comprises a mutation relative to a naturally occurring A Subunit of a member of the Shiga toxin family that changes the enzymatic activity of the Shiga toxin effector polypeptide, the mutation selected from at least one amino acid residue deletion, insertion, or substitution, such as, e.g., A231E, N75A, Y77S, Y114S, E167D, R170A, R176K and/or W203A in SEQ ID NO:1, SEQ ID NO:2, SEQ ID NO:3, or SEQ ID NO:4. In certain further embodiments, the mutation is selected from at least one amino acid residue deletion, insertion, or substitution that reduces or eliminates catalytic activity but retains at least one other Shiga toxin effector function, such as, e.g., inducing cellular internalization and/or directing subcellular routing. In certain further embodiments, the mutation reduces or eliminates cytotoxicity of the Shiga toxin effecter polypeptide.

In certain embodiments, the Shiga toxin effector polypeptide of the present invention is a polypeptide derived from an A Subunit of a member of the Shiga Toxin Family and comprises an internal, ectopic amino acid residue having a functional group suitable for chemical conjugation via the functional group to a heterologous molecule, which is heterologous to Shiga toxins; and wherein the Shiga toxin effector polypeptide is capable of exhibiting a Shiga toxin effector function. Internal refers to the ectopic amino acid residue being incorporated within a single, continuous polypeptide at position representing neither the amino-terminal residue nor the carboxy-terminal residue. In certain further embodiments, the ectopic amino acid residue is a basic and/or strongly nucleophilic amino acid residue, and optionally a cysteine, histidine, lysine, selenocysteine, or pyrroline-carboxy-lysine. In certain further embodiments, the ectopic amino acid residue is non-natural—meaning that amino acid is not one of the twenty common amino acids. In certain further embodiments, the ectopic amino acid residue is capable of being incorporated in the Shiga toxin effector polypeptide via nucleic acid translation. In certain further embodiments, the Shiga toxin effector polypeptide comprises or consists essentially of the polypeptide shown in any one of SEQ ID NOs: 5-84, 830, 832, and 1109-1140. For certain further embodiments, the Shiga toxin effector polypeptide is capable of exhibiting significant intracellular routing from an endosomal compartment to a Golgi, endoplasmic reticulum, and/or cytosolic compartment. For certain further embodiments, the Shiga toxin effector polypeptide is capable of exhibiting a ribosome inhibition activity with an $IC_{50}$ value of 10,000 picomolar or less and/or significant level of Shiga toxin catalytic activity. In certain further embodiments, the Shiga toxin effector polypeptide is linked to a heterologous molecule via the ectopic amino acid residue. In certain further embodiments, the heterologous molecule is selected from the group consisting of: peptide, protein, nucleic acid, protein-nucleic acid complex, cytotoxic agent, antibiotic, and detection-promoting agent. For certain further embodiments, the heterologous molecule is capable of specifically binding at least one extracellular target biomolecule physically coupled to the surface of a cell. In certain further embodiments, the heterologous molecule comprises a cell-targeting polypeptide. In certain further embodiments, the cell-targeting polypeptide comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. For certain further embodiments, the heterologous molecule is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain further embodiments, the immunoglobulin-type binding region comprises the peptide or polypeptide shown in any one of SEQ ID NOs: 844-1100. In certain further embodiments, the Shiga toxin effector polypeptide comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the Shiga toxin effector polypeptide to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain embodiments of the Shiga toxin effector polypeptide of the present invention, administration of the Shiga toxin effector polypeptide a target-expressing cell, the Shiga toxin effector polypeptide is capable of causing death of the cell, i.e. killing the cell. In certain further embodiments, the Shiga toxin effector polypeptide comprises a mutation relative to a naturally occurring A Subunit of a member of the Shiga toxin family that changes the enzymatic activity of the Shiga toxin effector polypeptide, the mutation selected from at least one amino acid residue deletion, insertion, or substitution, such as, e.g., A231E, N75A, Y77S, Y114S, E167D, R170A, R176K and/or W203A in SEQ ID NO:1, SEQ ID NO:2, SEQ ID NO:3, or SEQ ID NO:4. In certain further embodiments, the mutation is selected from at least one amino acid residue deletion, insertion, or substitution that reduces or eliminates catalytic activity but retains at least one other Shiga toxin effector function, such as, e.g., inducing cellular internalization and/or directing subcellular routing. In certain further embodiments, the mutation reduces or eliminates cytotoxicity of the Shiga toxin effecter polypeptide.

In certain embodiments, the Shiga toxin effector polypeptide of the present invention is fused to a linker known to the skilled worker.

In certain embodiments, the Shiga toxin effector polypeptide of the present invention is fused, either directly or indirectly, to a binding region capable of specifically binding an extracellular target biomolecule.

In certain embodiments, the Shiga toxin effector polypeptide of the present invention further comprises a Shiga toxin A1 fragment derived region having a carboxy terminus and further comprises a disrupted furin-cleavage motif at the carboxy-terminus of the A1 fragment region (see e.g. WO 2015/191764; WO 2016/126950). In certain further embodiments, the Shiga toxin effector polypeptide of the present invention further comprises a molecular moiety located carboxy-terminal to the carboxy-terminus of the Shiga toxin A1 fragment region (see e.g. WO 2015/191764; WO 2016/126950).

In certain embodiments, the Shiga toxin effector polypeptide of the present invention further comprises at least one inserted or embedded, heterologous, T-cell epitope (see e.g. WO 2015/113005; WO 2016/126950).

In certain embodiments, the Shiga toxin effector polypeptide of the present invention is de-immunized. In certain embodiments, the Shiga toxin effector polypeptide of the present invention exhibits reduced antigenic and/or immunogenic potential after administration to a chordate as compared to a reference molecule, such as, e.g., a wild-type Shiga toxin effector polypeptide (see e.g. SEQ ID NOs: 1-3).

In certain embodiments, the Shiga toxin effector polypeptide of the present invention further comprises at least one, two, or three disrupted, endogenous, B-cell and/or CD4+ T-cell epitope regions. In certain further embodiments, the Shiga toxin effector polypeptide further comprises at least one disrupted, endogenous, B-cell and/or CD4+ T-cell epitope region which does not overlap with at least one inserted or embedded, heterologous epitope (see e.g. WO 2016/126950). In certain embodiments, the Shiga toxin effector polypeptide comprises a disruption in the B-cell and/or T-cell epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2, and 210-218 of SEQ ID NO:3; 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; 285-293 of SEQ ID NO:1 or SEQ ID NO:2; 4-33 of SEQ ID NO:1 or SEQ ID NO:2; 34-78 of SEQ ID NO:1 or SEQ ID NO:2; 77-103 of SEQ ID NO:1 or SEQ ID NO:2; 128-168 of SEQ ID NO:1 or SEQ ID NO:2; 160-183 of SEQ ID NO:1 or SEQ ID NO:2; 236-258 of SEQ ID NO:1 or SEQ ID NO:2; and 274-293 of SEQ ID NO:1 or SEQ ID NO:2; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments, the Shiga toxin effector polypeptide of the present invention further comprises a mutation, relative to a wild-type Shiga toxin A Subunit, in the B-cell immunogenic, amino acid residue selected from the group of natively positioned Shiga toxin A Subunit amino acid residues: L49, D197, D198, R204, and R205.

In certain embodiments, the Shiga toxin effector polypeptide of the present invention further comprises the embedded or inserted, heterologous, T-cell epitope disrupting the endogenous, B-cell and/or T-cell epitope region is selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof.

In certain embodiments, the Shiga toxin effector polypeptide of the present invention further comprises a mutation, relative to a wild-type Shiga toxin A Subunit, in the B-cell and/or T-cell epitope region selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is an amino-terminal truncation of sequences that overlap with part or all of at least one disrupted epitope region.

In certain embodiments, the Shiga toxin effector polypeptide of the present invention further comprises a disruption of at least one endogenous epitope region selected from the group of natively positioned Shiga toxin A Subunits consisting of: 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; or 210-218 of SEQ ID NO:3.

In certain embodiments, the Shiga toxin effector polypeptide of the present invention further comprises disruptions of at least four, five, six, seven, eight, or more endogenous, B-cell and/or T-cell epitope regions (see e.g. WO 2015/113007; WO 2016/126950).

In certain embodiments, the Shiga toxin effector polypeptide of the present invention further comprises one or more endogenous, B-cell and/or T-cell epitope regions comprising a plurality of amino acid residue substitutions relative to a wild-type Shiga toxin A Subunit (see e.g. WO 2015/113007; WO 2016/126950).

In certain embodiments, the Shiga toxin effector polypeptide of the present invention further comprises at least one, two, three, or four disruptions comprise a plurality of amino acid residue substitutions in the endogenous, B-cell and/or T-cell epitope region relative to a wild-type Shiga toxin A Subunit (see e.g. WO 2015/113007; WO 2016/126950).

In certain embodiments, the Shiga toxin effector polypeptide of the present invention further comprises at least one disruption comprises at least one, two, three, four, five, six, seven, eight, or more amino acid residue substitutions relative to a wild-type Shiga toxin A Subunit, and optionally wherein at least one substitution occurs at the natively positioned Shiga toxin A Subunit amino acid residue selected form the group consisting of: 1 of SEQ ID NO:1 or SEQ ID NO:2; 4 of SEQ ID NO:1, SEQ ID NO:2, or SEQ ID NO:3; 6 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 12 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1, SEQ ID NO:2, or SEQ ID NO:3; 47 of SEQ ID NO:1 or SEQ ID NO:2; 48 of SEQ ID NO:1, SEQ ID NO:2, or SEQ ID NO:3; 49 of SEQ ID NO:1, SEQ ID NO:2, or SEQ ID NO:3; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1, SEQ ID NO:2, or SEQ ID NO:3; 55 of SEQ ID NO:1 or SEQ ID NO:2; 56 of SEQ ID NO:1, SEQ ID NO:2, or SEQ ID NO:3; 57 of SEQ ID NO:1, SEQ ID NO:2, or SEQ ID NO:3; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1, SEQ ID NO:2, or SEQ ID NO:3; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1, SEQ ID NO:2, or SEQ ID NO:3; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1, SEQ ID NO:2, or SEQ ID NO:3; 112 of SEQ ID NO:1, SEQ ID NO:2, or SEQ ID NO:3; 141 of SEQ ID NO:1, SEQ ID NO:2, or SEQ ID NO:3; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 197 of SEQ ID NO:3; 198 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof. In certain further embodiments, at least two disruptions each comprise at least one amino acid residue substitutions relative to a wild-type Shiga toxin A Subunit selected form the group consisting of: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 45 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 53 of SEQ ID NO:1 or SEQ ID NO:2; 55 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 109 of SEQ ID NO:1, SEQ ID NO:2, or SEQ ID NO:3; 110 of SEQ ID NO:1 or SEQ ID NO:2; 112 of SEQ ID NO:1, SEQ ID NO:2, or SEQ ID NO:3; 147 of SEQ ID NO:1, SEQ ID NO:2, or SEQ ID NO:3; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 250 of SEQ ID NO:3; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof.

In certain embodiments, the Shiga toxin effector polypeptide of the present invention further comprises disruption of at least three, endogenous, B-cell and/or T-cell epitope regions selected from the group of consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3, or the equivalent region in a Shiga toxin A Subunit or derivative thereof, wherein there is no disruption which is an amino-terminal truncation of amino acid residues that overlap with part or all of at least one disrupted, endogenous, B-cell and/or T-cell epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is a carboxy-terminal truncation of amino acid residues that overlap with part or all of at least one disrupted, endogenous, B-cell and/or T-cell epitope and/or epitope region.

In certain embodiments, the Shiga toxin effector polypeptide of the present invention further comprises disruptions of at least two, endogenous, B-cell and/or T-cell epitope regions, wherein each disruption comprises one or more amino acid residue substitutions, and wherein the endogenous, B-cell and/or T-cell epitope regions are selected from the group of natively positioned Shiga toxin A Subunit regions consisting of: 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; or the equivalent region in a Shiga toxin A Subunit or derivative thereof.

In certain embodiments, the Shiga toxin effector polypeptide of the present invention further comprises at least one disruption comprising one or more amino acid residue substitutions relative to a wild-type Shiga toxin A Subunit is selected from the group consisting of: D to A, D to G, D to V, D to L, D to I, D to F, D to S, D to Q, D to M, D to R, E to A, E to G, E to V, E to L, E to I, E to F, E to S, E to Q, E to N, E to D, E to M, E to R, F to A, F to G, F to V, F to L, F to I, G to A, G to P, H to A, H to G, H to V, H to L, H to I, H to F, H to M, I to A, I to V, I to G, I to C, K to A, K to G, K to V, K to L, K to I, K to M, K to H, L to A, L to V, L to G, L to C, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, V to A, V to G, Y to A, Y to G, Y to V, Y to L, Y to I, Y to F, Y to M, and Y to T. In certain further embodiments, the one or more amino acid residue substitutions relative to a wild-type Shiga toxin A Subunit is selected from the group consisting of: D to A, D to G, D to V, D to L, D to I, D to F, D to S, D to Q, E to A, E to G, E to V, E to L, E to I, E to F, E to S, E to Q, E to N, E to D, E to M, E to R, G to A, H to A, H to G, H to V, H to L, H to I, H to F, H to M, K to A, K to G, K to V, K to L, K to I, K to M, K to H, L to A, L to G, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, Y to A, Y to G, Y to V, Y to L, Y to I, Y to F, and Y to M.

In certain embodiments, the at least one disruption comprises one or more amino acid residue substitutions relative to a wild-type Shiga toxin A Subunit selected from the group consisting of: K1 to A, G, V, L, I, F, M and H; T4 to A, G, V, L, I, F, M, and S; D6 to A, G, V, L, I, F, S, Q and R; S8 to A, G, V, I, L, F, and M; T9 to A, G, V, I, L, F, M, and S; S9 to A, G, V, L, I, F, and M; K11 to A, G, V, L, I, F, M and H; T12 to A, G, V, I, L, F, M, S, and K; S12 to A, G, V, I, L, F, and M; S33 to A, G, V, L, I, F, M, and C; S43 to A, G, V, L, I, F, and M; G44 to A or L; S45 to A, G, V, L, I, F, and M; T45 to A, G, V, L, I, F, and M; G46 to A and P; D47 to A, G, V, L, I, F, S, M, and Q; N48 to A, G, V, L, M and F; L49 to A, V, C, and G; Y49 to A, G, V, L, I, F, M, and T; F50 to A, G, V, L, I, and T; A51; D53 to A, G, V, L, I, F, S, and Q; V54 to A, G, I, and L; R55 to A, G, V, L, I, F, M, Q, S, K, and H; G56 to A and P; 157 to A, G, V, and M; L57 to A, V, C, G, M, and F; D58 to A, G, V, L, I, F, S, and Q; P59 to A, G, and F; E60 to A, G, V, L, I, F, S, Q, N, D, M, T, and R; E61 to A, G, V, L, I, F, S, Q, N, D, M, and R; G62 to A; R84 to A, G, V, L, I, F, M, Q, S, K, and H; V88 to A and G; 188 to A, V, C, and G; D94 to A, G, V, L, I, F, S, and Q; S96 to A, G, V, I, L, F, and M; T104 to A, G, V, L, I, F, M; and N; A105 to L; T107 to A, G, V, L, I, F, M, and P; S107 to A, G, V, L, I, F, M, and P; L108 to A, V, C, and G; S109 to A, G, V, I, L, F, and M; T109 to A, G, V, I, L, F, M, and S; G110 to A; S112 to A, G, V, L, I, F, and M; D111 to A, G, V, L, I, F, S, Q, and T; S112 to A, G, V, L, I, F, and M; D141 to A, G, V, L, I, F, S, and Q; G147 to A; V154 to A and G. R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, V and C; S186 to A, G, V, I, L, F, and M; G187 to A; R188 to A, G, V, L, I, F, M, Q, S, K, and H; S189 to A, G, V, I, L, F, and M; D197 to A, G, V, L, I, F, S, and Q; D198 to A, G, V, L, I, F, S, and Q; R204 to A, G, V, L, I, F, M, Q, S, K, and H; R205 to A, G, V, L, I, F, M, Q, S, K and H; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; D264 to A, G, V, L, I, F, S, and Q; G264 to A; and T286 to A, G, V, L, I, F, M, and S.

For certain further embodiments, upon administration of the Shiga toxin effector polypeptide of the present invention as a component of a cell-targeting molecule to a target-expressing cell expressing the extracellular target biomolecule, the Shiga toxin effector polypeptide is capable of causing death of the cell. For certain further embodiments, the cell is a target biomolecule-positive cell. For certain further embodiments, the cell is physically coupled with a significant amount of the extracellular target biomolecule. For certain further embodiments, Shiga toxin effector polypeptide of the present invention as a component of a cell-targeting molecule is capable when introduced to cells of exhibiting a cytotoxicity with a half-maximal inhibitory concentration ($CD_{50}$) value of 300 nM or less and/or capable of exhibiting a significant level of Shiga toxin cytotoxicity.

Embodiment Set #2—Shiga Toxin Effector Polypeptide Scaffolds

In certain embodiments, the Shiga toxin effector polypeptide scaffold of the present invention comprises i) a Shiga toxin effector polypeptide and ii) an additional proteinaceous structure wherein the additional proteinaceous structure comprises an amino acid residue not present in the Shiga toxin effector polypeptide, e.g. a unique amino acid residue and/or an amino acid residue having a functional group unique to the Shiga toxin effector polypeptide component of the Shiga toxin effector polypeptide scaffold (also referred to herein as the Shiga toxin effector polypeptide region or Shiga toxin effector region). The Shiga toxin effector polypeptide is derived from the A Subunit of at least one member of the Shiga toxin family and need not comprise any cell-targeting domain of a Shiga holotoxin or any part of a Shiga toxin B Subunit.

In certain further embodiments, the Shiga toxin effector polypeptide scaffold is capable of exhibiting one or more Shiga toxin effector functions. For certain further embodiments, the Shiga toxin effector polypeptide scaffold is capable of exhibiting a significant level of one or more Shiga toxin effector functions selected from promoting cellular internalization, directing subcellular routing to the cytosol after cell entry, catalytic inactivation of ribosomes, and cytotoxicity.

In certain embodiments, the Shiga toxin effector polypeptide scaffold of the present invention comprises (i) a proteinaceous structure having a unique amino acid and which does not comprise a Shiga toxin effector polypeptide and (ii) a Shiga toxin effector polypeptide which does not comprise the unique amino acid and which is capable of exhibiting one or more Shiga toxin effector functions; and wherein the proteinaceous structure and the Shiga toxin effector polypeptide are covalently linked together.

In certain further embodiments, the Shiga toxin effector polypeptide scaffold of the present invention is capable of exhibiting one or more Shiga toxin effector functions is selected from the group consisting of: directing intracellular routing to the Golgi apparatus of a cell in which the polypeptide scaffold is present, directing intracellular routing to the endoplasmic reticulum of a cell in which the polypeptide scaffold is present, directing intracellular routing to the cytosol of a cell in which the polypeptide scaffold is present, directing intracellular routing with a cargo linked directly or indirectly to the polypeptide scaffold, inhibiting a ribosome function, enzymatically inactivating a ribosome, and cytotoxicity. In certain further embodiments, the Shiga toxin effector polypeptide scaffold is capable of exhibiting a ribosome inhibition activity with an $IC_{50}$ value of 10,000 picomolar or less.

In certain further embodiments, the unique amino acid residue is a non-natural amino acid residue.

In certain further embodiments, the unique amino acid residue is capable of being incorporated in the Shiga toxin effector polypeptide scaffold via polynucleotide translation, such as via the action of a ribosome in vitro or via the action of a ribosome in a living cell.

In certain further embodiments, the unique amino acid residue is positioned internally in the Shiga toxin effector polypeptide scaffold.

In certain further embodiments, the unique amino acid residue is selected from the group consisting of: cysteine, histidine, lysine, selenocysteine, and pyrroline-carboxy-lysine.

In certain further embodiments, the Shiga toxin effector polypeptide scaffold of the present invention comprises or consists essentially of any one of SEQ ID NOs: 762-767.

In certain embodiments of the Shiga toxin effector polypeptide scaffold of the present invention, the unique amino acid residue is a cysteine, histidine, lysine, or uncommon/non-natural amino acid residue. In certain further embodiments, the unique amino acid residue is capable of being incorporated into the Shiga toxin effector polypeptide scaffold via a nucleic acid translation process.

In certain embodiments of the Shiga toxin effector polypeptide scaffold of the present invention, the additional proteinaceous structure is fused to the Shiga toxin effector polypeptide.

In certain further embodiments, the Shiga toxin effector polypeptide scaffold can be produced via nucleic acid translation.

In certain embodiments, the Shiga toxin effector polypeptide scaffold is covalently linked via the unique amino acid residue's functional group to a heterologous molecule, such as, e.g., a cell-targeting binding region, linker, additional exogenous material, cargo, cell-targeting altering agent. In certain further embodiments, the heterologous molecule is selected from the group consisting of: antibiotic, antigen, antigenic material, cytotoxic agent, radionucleide, cell-targeting molecule altering agent, detection-promoting agent, dye, T-cell epitope, fluorophore, immunogen, immunogenic material, enzyme, zymoxin, lipid, polymer, polyethylene glycol, serum albumin binding agent, small molecule chemotherapeutic agent, prodrug, peptide, protein, nucleic acid, and/or protein-nucleic acid complex.

In certain embodiments, the Shiga toxin effector polypeptide scaffold of the present invention comprises a Shiga toxin effector polypeptide of the present invention. In certain further embodiments, the Shiga toxin effector polypeptide is selected from any one of SEQ ID NOs: 233-756.

In certain embodiments, the Shiga toxin effector polypeptide scaffold of the present invention comprises i) a Shiga toxin effector polypeptide of the present invention and ii) a linker. In certain further embodiments of the Shiga toxin effector polypeptide scaffolds of the present invention, the Shiga toxin effector polypeptide component of the scaffold is selected from any one of SEQ ID NOs: 233-756 and the Shiga toxin effector polypeptide further comprises a linker. In certain further embodiments of the Shiga toxin effector polypeptide scaffolds of the present invention, the Shiga toxin effector polypeptide component of the scaffold is selected from any one of SEQ ID NOs: 233-756 and the Shiga toxin effector polypeptide scaffold further comprises a linker selected from any one of SEQ ID NOs: 757-761.

In certain embodiments of the Shiga toxin effector polypeptide scaffold of the present invention, the linker comprises a peptide or polypeptide which is fused to the carboxy-terminus of the Shiga toxin effector polypeptide.

In certain embodiments, the Shiga toxin effector polypeptide scaffold comprises only one cysteine, lysine, selenocysteine, and/or pyrroline-carboxy-lysine. In certain further embodiments of the Shiga toxin effector polypeptide scaffolds of the present invention, the Shiga toxin effector polypeptide component of the scaffold is selected from any one of SEQ ID NOs: 233-756 and the Shiga toxin effector polypeptide scaffold further comprises a linker selected from any one of SEQ ID NOs: 757-761 as long as there is a single, unique cysteine or lysine residue present in the scaffold outside of the Shiga toxin effector polypeptide. In certain further embodiments of the Shiga toxin effector polypeptide scaffolds of the present invention, the Shiga toxin effector polypeptide scaffold comprises or consists essentially of any one of SEQ ID NOs: 762-767.

In certain embodiments, the Shiga toxin effector polypeptide scaffold of the present invention is fused to a linker known to the skilled worker.

In certain embodiments, the Shiga toxin effector polypeptide scaffold of the present invention is fused, either directly or indirectly, to a binding region capable of specifically binding an extracellular target biomolecule. In certain further embodiments, the binding region is fused to the carboxy-terminus of the Shiga toxin effector polypeptide scaffold.

For certain embodiments, the Shiga toxin effector polypeptide scaffold of the present invention is capable of exhibiting significant intracellular routing from an endosomal compartment to a Golgi, endoplasmic reticulum, and/or cytosolic compartment.

For certain embodiments, the Shiga toxin effector polypeptide scaffold of the present invention is capable of exhibiting a ribosome inhibition activity with an $IC_{50}$ value of 10,000 picomolar or less and/or significant level of Shiga toxin catalytic activity.

For certain embodiments of the Shiga toxin effector polypeptide scaffold of the present invention, the heterologous molecule is selected from the group consisting of: peptide, protein, nucleic acid, protein-nucleic acid complex, cytotoxic agent, antibiotic, and detection-promoting agent. For certain further embodiments, the heterologous molecule is capable of specifically binding at least one extracellular target biomolecule physically coupled to the surface of a cell. In certain further embodiments, the heterologous molecule comprises a cell-targeting polypeptide. In certain further embodiments, the cell-targeting polypeptide comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. For certain further embodiments, the heterologous molecule is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. For certain further embodiments, administration of the Shiga toxin effector polypeptide scaffold to a cell physically coupled with the extracellular target biomolecule results in one or more of the following: (1) internalizing the cell-targeting molecule inside the cell, (2) subcellular routing of a Shiga toxin effector polypeptide scaffold of the cell-targeting molecule to the cell's cytosol, (3) disrupting the cell's ribosome function, and (4) killing of the cell. For certain further embodiments, administration of the Shiga toxin effector polypeptide scaffold of the present invention to a biomolecule target-expressing cell, the Shiga toxin effector polypeptide scaffold is capable of causing death of the cell, i.e. killing the cell.

In certain embodiments, the Shiga toxin effector polypeptide component of the Shiga toxin effector polypeptide scaffold of the present invention comprises a mutation relative to a naturally occurring A Subunit of a member of the Shiga toxin family that changes the enzymatic activity of the Shiga toxin effector polypeptide scaffold, the mutation selected from at least one amino acid residue deletion, insertion, or substitution, such as, e.g., A231E, N75A, Y77S, Y114S, E167D, R170A, R176K and/or W203A in SEQ ID NO:1, SEQ ID NO:2, SEQ ID NO:3, or SEQ ID NO:4. In certain further embodiments, the mutation is selected from at least one amino acid residue deletion, insertion, or substitution that reduces or eliminates catalytic activity but retains at least one other Shiga toxin effector function, such as, e.g., inducing cellular internalization and/or directing subcellular routing. In certain further embodiments, the mutation reduces or eliminates cytotoxicity of the Shiga toxin effecter polypeptide scaffold.

Embodiment Set #3—Cell-Targeting Molecules

In certain embodiments, the cell-targeting molecule of the present invention comprises (1) a Shiga toxin effector polypeptide of the present invention and/or described above; and (2) a cell-targeting agent or cell-targeting binding region capable of specifically binding at least one extracellular target biomolecule. In certain further embodiments, the cell-targeting molecule comprises a conjugated moiety. In certain further embodiments, the conjugated moiety is selected from the group consisting of: peptide, protein, nucleic acid, protein-nucleic acid complex, cytotoxic agent, antibiotic, and detection-promoting agent. In certain further embodiments, the cell-targeting binding region comprises a polypeptide. In certain further embodiments, the cell-targeting binding region comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain further embodiments, the binding region is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain embodiments, the binding region comprises the peptide or polypeptide shown in any one of SEQ ID NOs: 844-1100. In certain further embodiments, the cell-targeting molecule of the present invention comprises or consists essentially of the polypeptide shown in any one of SEQ ID NOs: 773-817, 835-837, and 1105-1108. In certain further embodiments, the cell-targeting molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the cell-targeting molecule of the present invention is capable of killing a cell. For certain further embodiments, upon administration of the cell-targeting molecule of the present invention to a cell physically coupled with the extracellular target biomolecule, the cell-targeting molecule is capable of causing the death of the cell, i.e. killing the cell.

In certain embodiments, the cell-targeting molecule of the present invention comprises (1) a toxin effector protein and (2) a cell-targeting agent or cell-targeting binding region capable of specifically binding at least one extracellular target biomolecule. In certain further embodiments, the cell-targeting molecule comprises the linker of any one of SEQ ID NOs: 757-761 and 768-772. In certain further embodiments, the cell-targeting molecule comprises a conjugated molecule comprising a moiety selected from the group consisting of: peptide, protein, nucleic acid, protein-nucleic acid complex, cytotoxic agent, antibiotic, and detection-promoting agent. In certain further embodiments, the cell-targeting binding region comprises a polypeptide. In certain further embodiments, the cell-targeting binding region comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain further embodiments, the binding region is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain further embodiments, the cell-targeting molecule of the present invention comprises the polypeptide shown in any one of SEQ ID NOs: 773-817, 835-837, and 844-1108. In certain further embodiments, the cell-targeting molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the cell-targeting molecule of the present invention is capable of killing a cell. For certain further embodiments, upon administration of the cell-targeting molecule of the present invention to a cell physically coupled with the extracellular target biomolecule, the cell-targeting molecule is capable of causing the death of the cell, i.e. killing the cell.

In certain embodiments, the cell-targeting molecule of the present invention comprises (1) a proteinaceous component comprising the polypeptide shown in any one of SEQ ID NOs: 1-92, 830, 832, and 1109-1140; and (2) a cell-targeting agent or cell-targeting binding region capable of specifically binding at least one extracellular target biomolecule. In certain further embodiments, the cell-targeting molecule comprises a conjugated moiety. In certain further embodiments, the conjugated moiety is selected from the group consisting of: peptide, protein, nucleic acid, protein-nucleic acid complex, cytotoxic agent, antibiotic, and detection-promoting agent. In certain further embodiments, the cell-targeting binding region comprises a polypeptide. In certain further embodiments, the cell-targeting binding region comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain further embodiments, the binding region is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB 1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain further embodiments, the binding region comprises the peptide or polypeptide shown in any one of SEQ ID NOs: 844-1100. In certain further embodiments, the cell-targeting molecule of the present invention consists essentially of the polypeptide shown in any one of SEQ ID NOs: 773-817, 835-837, and 1105-1108. In certain further embodiments, the cell-targeting molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the cell-targeting molecule of the present invention is capable of killing a cell. For certain further embodiments, upon administration of the cell-targeting molecule of the present invention to a cell physically coupled with the extracellular target biomolecule, the cell-targeting molecule is capable of causing the death of the cell, i.e. killing the cell.

In certain embodiments, the cell-targeting molecule of the present invention comprises a (1) a Shiga toxin effector polypeptide that does not comprise any cysteine residues; (2) a cell-targeting binding region capable of specifically binding at least one extracellular target biomolecule; and (3) a proteinaceous linker which is fused between the Shiga toxin effector polypeptide and the cell-targeting binding region to form a continuous polypeptide. In certain further embodiments, the linker comprises one or more cysteine residues. In certain further embodiments, the linker is selected from the group consisting of any one of SEQ ID NOs: 757-760. In certain other embodiments, the cell-targeting binding region comprises one or more cysteine residues. In certain further embodiments, the cell-targeting binding region comprises the polypeptide selected from the group consisting of amino acids 269-499 of any one of SEQ ID NOs: 807-808 and 812-813, amino acids of 269-519 of any one of SEQ ID NOs: 814-815 and 818-829, or amino acids 268-386 of any one of SEQ ID NOs: 816-817. In certain further embodiments, the Shiga toxin effector polypeptide comprises or consists essentially of any one of SEQ ID NOs: 721-756. In certain further embodiments, the cell-targeting molecule of the present invention comprises only one free cysteine residue (i.e. a unique cysteine residue available for conjugation to a heterologous molecule). In certain further embodiments, the cell-targeting molecule comprises a heterologous molecule covalently linked either directly or indirectly to a cysteine residue. In certain further embodiments, the heterologous molecule is selected from the group consisting of: peptide, protein, nucleic acid, protein-nucleic acid complex, cytotoxic agent, antibiotic, and detection-promoting agent. In certain further embodiments, the cell-targeting binding region comprises a polypeptide. In certain further embodiments, the cell-targeting binding region comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_H$H or $V_H$ domain fragment), heavy-chain antibody domain derived from a cartilaginous fish ($V_H$H or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain further embodiments, the binding region is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain embodiments, the binding region comprises the peptide or polypeptide shown in any one of SEQ ID NOs: 844-1100. In certain further embodiments, the cell-targeting molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the cell-targeting molecule of the present invention is capable of killing a cell. For certain further embodiments, upon administration of the cell-targeting molecule of the present invention to a cell physically coupled with the extracellular target biomolecule, the cell-targeting molecule is capable of causing the death of the cell, i.e. killing the cell.

In certain embodiments, the cell-targeting molecule of the present invention comprises a (1) a Shiga toxin effector polypeptide that does not comprise any cysteine and/or selenocysteine residues; (2) a cell-targeting binding region capable of specifically binding at least one extracellular target biomolecule; and (3) a proteinaceous linker which is fused between the Shiga toxin effector polypeptide and the cell-targeting binding region to form a continuous polypeptide. In certain further embodiments, the linker comprises one or more selenocysteine residues. In certain other embodiments, the cell-targeting binding region comprises one or more selenocysteine residues. In certain further embodiments, the Shiga toxin effector polypeptide comprises or consists essentially of any one of SEQ ID NOs: 721-756. In certain further embodiments, the cell-targeting molecule of the present invention comprises only one selenocysteine residue. In certain further embodiments, the cell-targeting molecule comprises a heterologous molecule covalently linked either directly or indirectly to a selenocysteine residue. In certain further embodiments, the heterologous molecule is selected from the group consisting of: peptide, protein, nucleic acid, protein-nucleic acid complex, cytotoxic agent, antibiotic, and detection-promoting agent. In certain further embodiments, the cell-targeting binding region comprises a polypeptide. In certain further embodiments, the cell-targeting binding region comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_H$H or $V_H$ domain fragment), heavy-chain antibody domain derived from a cartilaginous fish ($V_H$H or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain further embodiments, the binding region is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain embodiments, the binding region comprises the peptide or polypeptide shown in any one of SEQ ID NOs: 844-1100. In certain further embodiments, the cell-targeting molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the cell-targeting molecule of the present invention is capable of killing a cell. For certain further embodiments, upon administration of the cell-targeting molecule of the present invention to a cell physically coupled with the extracellular target biomolecule, the cell-targeting molecule is capable of causing the death of the cell, i.e. killing the cell.

In certain embodiments, the cell-targeting molecule of the present invention comprises a (1) a Shiga toxin effector polypeptide that does not comprise any lysine residues; (2) a cell-targeting binding region capable of specifically binding at least one extracellular target biomolecule; and (3) a proteinaceous linker which is fused between the Shiga toxin effector polypeptide and the cell-targeting binding region to form a continuous polypeptide. In certain further embodiments, the linker comprises one or more lysine residues. In certain further embodiments, the linker is selected from the group consisting of any one of SEQ ID NOs: 757-761 and 771-772. In certain other embodiments, the cell-targeting binding region comprises one or more lysine residues. In certain further embodiments, the cell-targeting binding region comprises the polypeptide selected from the group consisting of amino acids 269-499 of any one of SEQ ID NOs: 807-808 and 812-813, amino acids of 269-519 of any one of SEQ ID NOs: 814-815 and 818-829, or amino acids 268-386 of any one of SEQ ID NOs: 816-817. In certain further embodiments, the Shiga toxin effector polypeptide comprises or consists essentially of any one of SEQ ID NOs: 233-720. In certain further embodiments, the cell-targeting molecule of the present invention comprises only one lysine residue (a unique lysine residue available for conjugation to a heterologous molecule). In certain further embodiments, the cell-targeting molecule comprises a heterologous molecule covalently linked either directly or indirectly to a lysine residue. In certain further embodiments, the heterologous molecule is selected from the group consisting of: peptide, protein, nucleic acid, protein-nucleic acid complex, cytotoxic agent, antibiotic, and detection-promoting agent. In certain further embodiments, the cell-targeting binding region comprises a polypeptide. In certain further embodiments, the cell-targeting binding region comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain further embodiments, the binding region is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain embodiments, the binding region comprises the peptide or polypeptide shown in any one of SEQ ID NOs: 844-1100. In certain further embodiments, the cell-targeting molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the cell-targeting molecule of the present invention is capable of killing a cell. For certain further embodiments, upon administration of the cell-targeting molecule of the present invention to a cell physically coupled with the extracellular target biomolecule, the cell-targeting molecule is capable of causing the death of the cell, i.e. killing the cell.

In certain embodiments, the cell-targeting molecule of the present invention comprises a (1) a Shiga toxin effector polypeptide that does not comprise any lysine and/or pyrroline-carboxy-lysine residues; (2) a cell-targeting binding region capable of specifically binding at least one extracellular target biomolecule; and (3) a proteinaceous linker which is fused between the Shiga toxin effector polypeptide and the cell-targeting binding region to form a continuous polypeptide. In certain further embodiments, the linker comprises one or more pyrroline-carboxy-lysine residues. In certain further embodiments, the linker is selected from the group consisting of any one of SEQ ID NOs: 757-761 and 771-772. In certain other embodiments, the cell-targeting binding region comprises one or more pyrroline-carboxy-lysine residues. In certain further embodiments, the cell-targeting binding region comprises the polypeptide selected from the group consisting of amino acids 269-499 of any one of SEQ ID NOs: 807-808 and 812-813, amino acids of 269-519 of any one of SEQ ID NOs: 814-815 and 818-829, or amino acids 268-386 of any one of SEQ ID NOs: 816-817. In certain further embodiments, the Shiga toxin effector polypeptide comprises or consists essentially of any one of SEQ ID NOs: 233-720. In certain further embodiments, the cell-targeting molecule of the present invention comprises only one pyrroline-carboxy-lysine residue (a unique pyrroline-carboxy-lysine residue available for conjugation to a heterologous molecule). In certain further embodiments, the cell-targeting molecule comprises a heterologous molecule covalently linked either directly or indirectly to a pyrroline-carboxy-lysine residue. In certain further embodiments, the heterologous molecule is selected from the group consisting of: peptide, protein, nucleic acid, protein-nucleic acid complex, cytotoxic agent, antibiotic, and detection-promoting agent. In certain further embodiments, the cell-targeting binding region comprises a polypeptide. In certain further embodiments, the cell-targeting binding region comprises an immunoglobulin-type binding region. In certain further embodiments, the immunoglobulin-type binding region comprises a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality. In certain further embodiments, the binding region is capable of binding to the extracellular target biomolecule selected from the group consisting of: CD20, PD-L1, CD22, CD40, CD79, CD25, CD30, HER2/neu/ErbB2, EGFR, EpCAM, EphB2, prostate-specific membrane antigen, Cripto, endoglin, fibroblast activated protein, Lewis-Y, CD19, CD21, CS1/SLAMF7, CD33, CD52, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, human tyrosinase-related protein 1, HPV-E7, Epstein-Barr Virus antigen, Bcr-Abl, alpha-fetoprotein antigen, 17-A1, bladder tumor antigen, SAIL, CD38, CD15, CD23, CD53, CD88, CD129, CD183, CD191, CD193, CD244, CD294, CD305; C3AR, FceRIa, galectin-9, mrp-14, siglec-8, siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC Class II, CD284-TLR4, CD107-Mac3, CD195-CCR5, HLA-DR, CD16/32, CD282-TLR2, and any immunogenic fragment of any of the foregoing. In certain embodiments, the binding region comprises the peptide or polypeptide shown in any one of SEQ ID NOs: 844-1100. In certain further embodiments, the cell-targeting molecule comprises a carboxy-terminal endoplasmic reticulum retention/retrieval signal motif of a member of the KDEL family. In certain further embodiments, the carboxy-terminal endoplasmic reticulum retention/retrieval signal motif is selected from the group consisting of: KDEL, HDEF, HDEL, RDEF, RDEL, WDEL, YDEL, HEEF, HEEL, KEEL, REEL, KAEL, KCEL, KFEL, KGEL, KHEL, KLEL, KNEL, KQEL, KREL, KSEL, KVEL, KWEL, KYEL, KEDL, KIEL, DKEL, FDEL, KDEF, KKEL, HADL, HAEL, HIEL, HNEL, HTEL, KTEL, HVEL, NDEL, QDEL, REDL, RNEL, RTDL, RTEL, SDEL, TDEL, SKEL, STEL, and EDEL. For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the cell-targeting molecule of the present invention is capable of killing a cell. For certain further embodiments, upon administration of the cell-targeting molecule of the present invention to a cell physically coupled with the extracellular target biomolecule, the cell-targeting molecule is capable of causing the death of the cell, i.e. killing the cell.

In certain embodiments of Embodiment Sets #1 to #3, the Shiga toxin effector polypeptide has a Shiga toxin A1 fragment derived region having a carboxy terminus and further comprises a disrupted furin-cleavage motif at the carboxy-terminus of the A1 fragment region.

In certain embodiments of Embodiment Sets #1 and #3, the molecule comprises a molecular moiety located carboxy-terminal to the carboxy-terminus of the Shiga toxin A1 fragment region.

In certain embodiments of Embodiment Sets #1 to #3, the cell-targeting molecule of the present invention, or a polypeptide component thereof, comprises a carboxy-terminal, endoplasmic reticulum retention/retrieval signal motif of a member of the KDEL family. For certain further embodiments, the carboxy-terminal endoplasmic reticulum retention/retrieval signal motif is selected from the group consisting of: KDEL (SEQ ID NO:1142), HDEF (SEQ ID NO:1143), HDEL (SEQ ID NO:1144), RDEF (SEQ ID NO:1145), RDEL (SEQ ID NO:1146), WDEL (SEQ ID NO:1147), YDEL (SEQ ID NO:1148), HEEF (SEQ ID NO:1149), HEEL (SEQ ID NO:1150), KEEL (SEQ ID NO:1151), REEL (SEQ ID NO:1152), KAEL (SEQ ID NO:1153), KCEL (SEQ ID NO:1154), KFEL (SEQ ID NO:1155), KGEL (SEQ ID NO:1156), KHEL (SEQ ID NO:1157), KLEL (SEQ ID NO:1158), KNEL (SEQ ID NO:1159), KQEL (SEQ ID NO:1160), KREL (SEQ ID NO:1161), KSEL (SEQ ID NO:1162), KVEL (SEQ ID NO:1163), KWEL (SEQ ID NO:1164), KYEL (SEQ ID NO:1165), KEDL (SEQ ID NO:1166), KIEL (SEQ ID NO:1167), DKEL (SEQ ID NO:1168), FDEL (SEQ ID NO:1169), KDEF (SEQ ID NO:1170), KKEL (SEQ ID NO:1171), HADL (SEQ ID NO:1172), HAEL (SEQ ID NO:1173), HIEL (SEQ ID NO:1174), HNEL (SEQ ID NO:1175), HTEL (SEQ ID NO:1176), KTEL (SEQ ID NO:1177), HVEL (SEQ ID NO:1178), NDEL (SEQ ID NO:1179), QDEL (SEQ ID NO:1180), REDL (SEQ ID NO:1181), RNEL (SEQ ID NO:1182), RTDL (SEQ ID NO:1183), RTEL (SEQ ID NO:1184), SDEL (SEQ ID NO:1185), TDEL (SEQ ID NO:1186), SKEL (SEQ ID NO:1187), STEL (SEQ ID NO:1188), and EDEL (SEQ ID NO:1189). In certain further embodiments, the cell-targeting molecule of the present invention is capable when introduced to cells of exhibiting cytotoxicity that is greater than that of a reference molecule, such as, e.g., a reference cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the reference cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the reference cell-targeting molecule to a second population of target positive cells as assayed by $CD_{50}$ values.

In certain embodiments of Embodiment Sets #1 to #3, the Shiga toxin effector polypeptide further comprises at least one inserted or embedded, heterologous epitope.

In certain embodiments of Embodiment Sets #1 to #3, the Shiga toxin effector polypeptide further comprises at least one, two, or three disrupted, endogenous, B-cell and/or CD4+ T-cell epitope regions. In certain further embodiments, the Shiga toxin effector polypeptide comprises a disruption of at least one, two, or three endogenous, B-cell and/or T-cell epitopes and/or epitope regions. In certain further embodiments, the Shiga toxin effector polypeptide further comprises at least one disrupted, endogenous, B-cell and/or CD4+ T-cell epitope region which does not overlap with at least one inserted or embedded, heterologous epitope.

In certain embodiments of Embodiment Sets #1 to #3, the Shiga toxin effector polypeptide further comprises a disruption in the B-cell and/or T-cell epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2, and 210-218 of SEQ ID NO:3; 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; 285-293 of SEQ ID NO:1 or SEQ ID NO:2; 4-33 of SEQ ID NO:1 or SEQ ID NO:2; 34-78 of SEQ ID NO:1 or SEQ ID NO:2; 77-103 of SEQ ID NO:1 or SEQ ID NO:2; 128-168 of SEQ ID NO:1 or SEQ ID NO:2; 160-183 of SEQ ID NO:1 or SEQ ID NO:2; 236-258 of SEQ ID NO:1 or SEQ ID NO:2; and 274-293 of SEQ ID NO:1 or SEQ ID NO:2; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Sets #1 to #3, the Shiga toxin effector polypeptide further comprises a mutation, relative to a wild-type Shiga toxin A Subunit, in the B-cell immunogenic, amino acid residue selected from the group of natively positioned Shiga toxin A Subunit amino acid residues: L49, D197, D198, R204, and R205.

In certain embodiments of Embodiment Sets #1 to #3, the embedded or inserted, heterologous, T-cell epitope disrupts the endogenous, B-cell and/or T-cell epitope region is selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof.

In certain embodiments of Embodiment Sets #1 to #3, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is an amino-terminal truncation of sequences that overlap with part or all of at least one disrupted epitope region.

In certain embodiments of Embodiment Sets #1 to #3, the Shiga toxin effector polypeptide comprises a disruption of at least one endogenous epitope region selected from the group of natively positioned Shiga toxin A Subunits consisting of: 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; or 210-218 of SEQ ID NO:3.

In certain embodiments of Embodiment Sets #1 to #3, the Shiga toxin effector polypeptide does not comprise a heterologous, MHC class I-restricted, T-cell epitope. MHC class I-restricted, T-cell epitopes are known in the art or can be predicted by the skilled worker. The term heterologous refers to MHC class I-restricted, T-cell epitopes which are not natively present in wild-type Shiga toxin A Subunits, such as, e.g., the wild-type Shiga toxin A Subunit which is most closely related to the Shiga toxin effector polypeptide of interest.

In certain embodiments of Embodiment Sets #1 to #3, the Shiga toxin effector polypeptide comprises disruptions of at least four, five, six, seven, eight, or more endogenous, B-cell and/or T-cell epitope regions.

In certain embodiments of Embodiment Sets #1 to #3, one or more disruptions comprises an amino acid residue substitution relative to a wild-type Shiga toxin A Subunit.

In certain embodiments of Embodiment Sets #1 to #3, one or more endogenous, B-cell and/or T-cell epitope regions comprises a plurality of amino acid residue substitutions relative to a wild-type Shiga toxin A Subunit.

In certain embodiments of Embodiment Sets #1 to #3, at least one, two, three, or four disruptions comprise a plurality of amino acid residue substitutions in the endogenous, B-cell and/or T-cell epitope region relative to a wild-type Shiga toxin A Subunit.

In certain embodiments of Embodiment Sets #1 to #3, at least one disruption comprises at least one, two, three, four, five, six, seven, eight, or more amino acid residue substitutions relative to a wild-type Shiga toxin A Subunit, and optionally wherein at least one substitution occurs at the natively positioned Shiga toxin A Subunit amino acid residue selected form the group consisting of: 1 of SEQ ID NO:1 or SEQ ID NO:2; 4 of SEQ ID NO:1, SEQ ID NO:2, or SEQ ID NO:3; 6 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3;

11 of SEQ ID NO:1, SEQ ID NO:2, or SEQ ID NO:3; 12 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1, SEQ ID NO:2, or SEQ ID NO:3; 47 of SEQ ID NO:1 or SEQ ID NO:2; 48 of SEQ ID NO:1, SEQ ID NO:2, or SEQ ID NO:3; 49 of SEQ ID NO:1, SEQ ID NO:2, or SEQ ID NO:3; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1, SEQ ID NO:2, or SEQ ID NO:3; 55 of SEQ ID NO:1 or SEQ ID NO:2; 56 of SEQ ID NO:1, SEQ ID NO:2, or SEQ ID NO:3; 57 of SEQ ID NO:1, SEQ ID NO:2, or SEQ ID NO:3; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1, SEQ ID NO:2, or SEQ ID NO:3; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1, SEQ ID NO:2, or SEQ ID NO:3; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1, SEQ ID NO:2, or SEQ ID NO:3; 112 of SEQ ID NO:1, SEQ ID NO:2, or SEQ ID NO:3; 141 of SEQ ID NO:1, SEQ ID NO:2, or SEQ ID NO:3; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 197 of SEQ ID NO:3; 198 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof. In certain further embodiments, at least two disruptions each comprise at least one amino acid residue substitutions relative to a wild-type Shiga toxin A Subunit selected form the group consisting of: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 45 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 53 of SEQ ID NO:1 or SEQ ID NO:2; 55 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 109 of SEQ ID NO:1, SEQ ID NO:2, or SEQ ID NO:3; 110 of SEQ ID NO:1 or SEQ ID NO:2; 112 of SEQ ID NO:1, SEQ ID NO:2, or SEQ ID NO:3; 147 of SEQ ID NO:1, SEQ ID NO:2, or SEQ ID NO:3; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 250 of SEQ ID NO:3; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof.

In certain embodiments of Embodiment Sets #1 to #3, the Shiga toxin effector polypeptide comprises disruption of at least three, endogenous, B-cell and/or T-cell epitope regions selected from the group of consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3, or the equivalent region in a Shiga toxin A Subunit or derivative thereof, wherein there is no disruption which is an amino-terminal truncation of amino acid residues that overlap with part or all of at least one disrupted, endogenous, B-cell and/or T-cell epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is a carboxy-terminal truncation of amino acid residues that overlap with part or all of at least one disrupted, endogenous, B-cell and/or T-cell epitope and/or epitope region.

In certain embodiments of Embodiment Sets #1 to #3, the Shiga toxin effector polypeptide comprises disruptions of at least two, endogenous, B-cell and/or T-cell epitope regions, wherein each disruption comprises one or more amino acid residue substitutions, and wherein the endogenous, B-cell and/or T-cell epitope regions are selected from the group of natively positioned Shiga toxin A Subunit regions consisting of: 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; or the equivalent region in a Shiga toxin A Subunit or derivative thereof.

In certain embodiments of Embodiment Sets #1 to #3, the embedded or inserted, heterologous, T-cell epitope does not disrupt any endogenous, B-cell and/or CD4+ T-cell epitope region described herein.

In certain embodiments of Embodiment Sets #1 to #3, at least one disruption comprises one or more amino acid residue substitutions relative to a wild-type Shiga toxin A Subunit is selected from the group consisting of: D to A, D to G, D to V, D to L, D to I, D to F, D to S, D to Q, D to M, D to R, E to A, E to G, E to V, E to L, E to I, E to F, E to S, E to Q, E to N, E to D, E to M, E to R, F to A, F to G, F to V, F to L, F to I, G to A, G to P, H to A, H to G, H to V, H to L, H to I, H to F, H to M, I to A, I to V, I to G, I to C, K to A, K to G, K to V, K to L, K to I, K to M, K to H, L to A, L to V, L to G, L to C, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, V to A, V to G, Y to A, Y to G, Y to V, Y to L, Y to I, Y to F, Y to M, and Y to T. In certain further embodiments, the one or more amino acid residue substitutions relative to a wild-type Shiga toxin A Subunit is selected from the group consisting of: D to A, D to G, D to V, D to L, D to I, D to F, D to S, D to Q, E to A, E to G, E to V, E to L, E to I, E to F, E to S, E to Q, E to N, E to D, E to M, E to R, G to A, H to A, H to G, H to V, H to L, H to I, H to F, H to M, K to A, K to G, K to V, K to L, K to I, K to M, K to H, L to A, L to G, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, Y to A, Y to G, Y to V, Y to L, Y to I, Y to F, and Y to M.

In certain embodiments of Embodiment Sets #1 to #3, at least one of the disruption(s) comprises one or more amino acid residue substitutions relative to a wild-type Shiga toxin A Subunit selected from the group consisting of: K1 to A, G, V, L, I, F, M and H; T4 to A, G, V, L, I, F, M, and S; D6 to A, G, V, L, I, F, S, Q and R; S8 to A, G, V, I, L, F, and M; T9 to A, G, V, I, L, F, M, and S; S9 to A, G, V, L, I, F, and M; K11 to A, G, V, L, I, F, M and H; T12 to A, G, V, I, L, F, M, S, and K; S12 to A, G, V, I, L, F, and M; S33 to A, G, V, L, I, F, M, and C; S43 to A, G, V, L, I, F, and M; G44 to A or L; S45 to A, G, V, L, I, F, and M; T45 to A, G, V, L, I, F, and M; G46 to A and P; D47 to A, G, V, L, I, F, S, M, and Q; N48 to A, G, V, L, M and F; L49 to A, V, C, and G; Y49 to A, G, V, L, I, F, M, and T; F50 to A, G, V, L, I, and T; A51; D53 to A, G, V, L, I, F, S, and Q; V54 to A, G, I, and L; R55 to A, G, V, L, I, F, M, Q, S, K, and H; G56 to A and P; 157 to A, G, V, and M; L57 to A, V, C, G, M, and F; D58 to A, G, V, L, I, F, S, and Q; P59 to A, G, and F; E60 to A, G, V, L, I, F, S, Q, N, D, M, T, and R; E61 to A, G, V, L, I, F, S, Q, N, D, M, and R; G62 to A; R84 to A, G, V, L, I, F, M, Q, S, K, and H; V88 to A and G; 188 to A, V, C, and G; D94 to A, G, V, L, I, F, S, and Q; S96 to A, G, V, I, L, F, and M; T104 to A, G, V, L, I, F, M; and N; A105 to L; T107 to A, G, V, L, I, F, M, and P; S107 to A, G, V, L, I, F, M, and P; L108 to A, V, C, and G; S109 to A, G, V, I, L, F, and M; T109 to A, G, V, I, L, F, M, and S; G110 to A; S112 to A, G, V, L, I, F, and M; D111 to A, G, V, L, I, F, S, Q, and T; S112 to A, G, V, L, I, F, and M; D141 to A, G, V, L, I, F, S, and Q; G147 to A; V154 to A and G. R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, V and C; S186 to A, G, V, I, L, F, and M; G187 to A; R188 to A, G, V, L, I, F, M, Q, S, K, and H; S189 to A, G, V, I, L, F, and M; D197 to A, G, V, L, I, F, S, and Q; D198 to A, G, V, L, I, F, S, and Q; R204 to A, G, V, L, I, F, M, Q, S, K, and H; R205 to A, G, V, L, I, F, M, Q, S, K and H; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; D264 to A, G, V, L, I, F, S, and Q; G264 to A; and T286 to A, G, V, L, I, F, M, and S.

In certain embodiments of Embodiment Sets #1 to #3, the binding region and Shiga toxin effector polypeptide are linked together, either directly or indirectly.

For certain embodiments of Embodiment Sets #1 to #3, the molecule of the present invention and/or its Shiga toxin effector polypeptide is capable of exhibiting subcellular routing efficiency comparable to a reference cell-targeting molecule comprising a wild-type Shiga toxin A1 fragment or wild-type Shiga toxin effector polypeptide and/or capable of exhibiting a significant level of intracellular routing activity to the endoplasmic reticulum and/or cytosol from an endosomal starting location of a cell.

For certain embodiments of Embodiment Sets #1 to #3, the molecule of the present invention is capable of exhibiting (i) a catalytic activity level comparable to a wild-type Shiga toxin A1 fragment or wild-type Shiga toxin effector polypeptide, (ii) a ribosome inhibition activity with a half-maximal inhibitory concentration ($IC_{50}$) value of 10,000 picomolar or less, and/or (iii) a significant level of Shiga toxin catalytic activity.

In certain embodiments of Embodiment Sets #1 to #3, the molecule comprises a molecular moiety associated with the carboxy-terminus of the Shiga toxin effector polypeptide. In certain embodiments, the molecular moiety comprises or consists of the binding region. In certain embodiments, the molecular moiety comprises at least one amino acid and the Shiga toxin effector polypeptide is linked to at least one amino acid residue of the molecular moiety. In certain further embodiments, the molecular moiety and the Shiga toxin effector polypeptide are fused forming a continuous polypeptide.

In certain embodiments of Embodiment Sets #1 to #3, the disrupted furin-cleavage motif comprises one or more mutations in the minimal, furin-cleavage site relative to a wild-type Shiga toxin A Subunit. In certain embodiments, the disrupted furin-cleavage motif is not an amino-terminal truncation of sequences that overlap with part or all of at least one amino acid residue of the minimal furin-cleavage site. In certain embodiments, the mutation in the minimal, furin-cleavage site is an amino acid deletion, insertion, and/or substitution of at least one amino acid residue in the R/Y-x-x-R furin cleavage motif. In certain further embodiments, the disrupted furin-cleavage motif comprises at least one mutation relative to a wild-type Shiga toxin A Subunit, the mutation altering at least one amino acid residue in the region natively positioned 1) at 248-251 of the A Subunit of Shiga-like toxin 1 (SEQ ID NO: 1) or Shiga toxin (SEQ ID NO: 2), or 2) at 247-250 of the A Subunit of Shiga-like toxin 2 (SEQ ID NO:3), or the equivalent amino acid sequence position in any Shiga toxin A Subunit. In certain further embodiments, the mutation is an amino acid residue substitution of an arginine residue with a non-positively charged, amino acid residue.

In certain embodiments of Embodiment Sets #1 to #3, the molecular moiety comprises a peptide and/or polypeptide derived from the Shiga toxin A2 fragment of a naturally occurring Shiga toxin.

In certain embodiments of Embodiment Sets #1 to #3, the Shiga toxin effector polypeptide comprises one or more mutations relative to a naturally occurring A Subunit of a member of the Shiga toxin family which changes an enzymatic activity of the Shiga toxin effector polypeptide, the mutation selected from at least one amino acid residue deletion, insertion, or substitution. In certain further embodiments, the mutation relative to the naturally occurring A Subunit reduces of eliminates a cytotoxic activity of the Shiga toxin effector polypeptide but the Shiga toxin effector polypeptide retains at least one other Shiga toxin effector function, such as, e.g., promoting cellular internalization and/or directing intracellular routing to a certain subcellular compartment(s). In certain further embodiments, the mutation relative to the naturally occurring A Subunit is selected from at least one amino acid residue substitution, such as, e.g., A231E, R75A, Y77S, Y114S, E167D, R170A, R176K, and/or W203A in SEQ ID NO:1, SEQ ID NO:2, or SEQ ID NO:3.

For certain embodiments of Embodiment Sets #1 to #3, the Shiga toxin effector polypeptide is capable of: (i) routing to a subcellular compartment of a cell in which the Shiga toxin effector polypeptide is present selected from the following: cytosol, endoplasmic reticulum, and lysosome; (ii) intracellular delivery of the epitope from an early endosomal compartment to a proteasome of a cell in which the Shiga toxin effector polypeptide is present; and/or (iii) intracellular delivery of the epitope to a MHC class I molecule from an early endosomal compartment of a cell in which the Shiga toxin effector polypeptide is present. In certain further embodiments, the Shiga toxin effector polypeptide is capable of intracellular delivery of the CD 8+ T-cell epitope for presentation by a MHC class I molecule on the surface of a cell in which the Shiga toxin effector polypeptide is present.

In certain embodiments, the cell-targeting molecule of the present invention comprises a binding region which comprises the immunoglobulin-type binding region comprising a polypeptide(s) selected from the group consisting of: (a) a heavy chain variable ($V_H$) domain comprising a HCDR1 comprising or consisting essentially of the amino acid sequences as shown in any one of SEQ ID NOs: 844, 850, 857, 863, 869, 875, 881, 885, 891, 897, 903, 909, 915, 921, 927, 933, 939, 948, 954, 960, 966, 972, 978, 984, 990, 996, 1002, 1008, 1014, 1020, 1026, 1032, 1035, 1041, 1044, 1050, 1056, 1062, 1065, 1071, 1077, 1083, 1089, and 1095; a HCDR2 comprising or consisting essentially of the amino acid sequences as shown in SEQ ID NOs: 845, 851, 856, 858, 864, 876, 886, 892, 898, 904, 910, 916, 922, 928, 934, 940, 949, 955, 961, 967, 973, 979, 985, 991, 997, 1003, 1009, 1015, 1021, 1027, 1036, 1042, 1045, 1051, 1057, 1063, 1066, 1072, 1078, 1084, 1090, and 1096; or a HCDR3 comprising or consisting essentially of the amino acid sequences as shown in any one of SEQ ID NOs: 846, 852, 859, 865, 870, 872, 877, 882, 887, 893, 899, 905, 911, 917, 923, 929, 935, 941, 950, 956, 962, 968, 974, 980, 982, 986, 992, 998, 1004, 1010, 1016, 1022, 1028, 1037, 1043, 1046, 1064, 1052, 1058, 1067, 1073, 1079, 1085, 1091, and 1097; and/or (b) a light chain variable ($V_L$) domain comprising a LCDR1 comprising or consisting essentially of the amino acid sequences as shown in any one of SEQ ID NOs: 847, 853, 860, 866, 871, 888, 894, 900, 906, 912, 918, 924, 930, 936, 942, 947, 953, 959, 965, 971, 977, 983, 989, 995, 1001, 1007, 1013, 1019, 1025, 1032, 1038, 1047, 1053, 1059, 1068, 1074, 1080, 1086, 1092, and 1098; a LCDR2 comprising or consisting essentially of the amino acid sequences as shown in any one of SEQ ID NOs: 848, 854, 861, 867, 883, 889, 895, 901, 907, 913, 919, 925, 931, 937, 948, 954, 960, 966, 972, 978, 984, 990, 996, 1002, 1008, 1014, 1020, 1026, 1033, 1039, 1048, 1054, 1060, 1069, 1075, 1081, 1087, 1093, and 1099; or a LCDR3 comprising or consisting essentially of the amino acid sequences as shown in any one of SEQ ID NOs: 849, 855, 862, 868, 884, 890, 896, 902, 908, 914, 920, 926, 932, 938, 949, 955, 961, 967, 973, 979, 985, 991, 997, 1003, 1009, 1015, 1021, 1027, 1034, 1040, 1049, 1055, 1061, 1070, 1076, 1082, 1088, 1094, and 1100.

In certain embodiments, the cell-targeting molecule of the present invention comprises the binding region comprising or consisting essentially of amino acids 269-499 of any one of SEQ ID NOs: 807-808 and 812-813, comprising or consisting essentially of amino acids of 269-519 of any one of SEQ ID NOs: 814-815 and 818-829, or comprising or consisting essentially of amino acids 268-386 of any one of SEQ ID NOs: 816-817.

In certain embodiments of Embodiment Sets #3, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., a reference cell-targeting molecule having an amino-terminus and comprising the binding region and the Shiga toxin effector polypeptide which is not positioned at or proximal to the amino-terminus of the reference cell-targeting molecule. For certain further embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of the reference cell-targeting molecule. For certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the reference cell-targeting molecule to a second population of target positive cells as assayed by $CD_{50}$ values. In certain further embodiments, the reference cell-targeting molecule does not comprise any carboxy-terminal, endoplasmic reticulum retention/retrieval signal motif of the KDEL family.

For certain embodiments of Embodiment Set #3, the cell-targeting molecule of the present invention is capable when introduced to a chordate of exhibiting improved in vivo tolerability and/or stability compared to a reference molecule, such as, e.g., a reference cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the Shiga toxin effector polypeptide is not cytotoxic and the molecular moiety is cytotoxic.

In certain embodiments of Embodiment Set #3, the binding region comprises at least one peptide and/or polypeptide. In certain further embodiments, the binding region is or comprises an immunoglobulin-type binding region. In certain further embodiments, the binding region comprising a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystallin-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality.

For certain embodiments of Embodiment Set #3, whereby administration of the cell-targeting molecule of the present invention to a cell physically coupled with the extracellular target biomolecule of the cell-targeting molecule's binding region, the cell-targeting molecule is capable of causing death of the cell. In certain further embodiments, administration of the cell-targeting molecule of the invention to two different populations of cell types which differ with respect to the presence or level of the extracellular target biomolecule, the cell-targeting molecule is capable of causing cell death to the cell-types physically coupled with an extracellular target biomolecule of the cytotoxic cell-targeting molecule's binding region at a $CD_{50}$ at least three times or less than the $CD_{50}$ to cell types which are not physically coupled with an extracellular target biomolecule of the cell-targeting molecule's binding region. For certain embodiments, whereby administration of the cell-targeting molecule of the present invention to a first populations of cells whose members are physically coupled to extracellular target biomolecules of the cell-targeting molecule's binding region, and a second population of cells whose members are not physically coupled to any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first populations of cells whose members are physically coupled to a significant amount of the extracellular target biomolecule of the cell-targeting molecule's binding region, and a second population of cells whose members are not physically coupled to a significant amount of any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first population of target biomolecule positive cells, and a second population of cells whose members do not express a significant amount of a target biomolecule of the cell-targeting molecule's binding region at a cellular surface, the cytotoxic effect of the cell-targeting molecule to members of the first population of cells relative to members of the second population of cells is at least 3-fold greater.

For certain embodiments of the cell-targeting molecule of the present invention, upon administration of the cell-targeting molecule to a first population of cells physically coupled to the target biomolecule, and a second population of cells, a cytotoxic effect of the cell-targeting molecule to members of said first population of cells relative to members of said second population of cells is at least 3-fold greater. For certain further embodiments, members of the first population of cells are target biomolecule-positive cells. For certain embodiments, members of the first population of cells over-express, at a cellular surface, the extracellular target biomolecule. For certain embodiments, the members of the second population of cells are not physically coupled with extracellular target biomolecule and/or are target biomolecule-negative. For certain embodiments of the cell-targeting molecule of the present invention, upon administration of the cell-targeting molecule to a first population of cells whose members are target biomolecule-positive, and a second population of cells whose members are not target biomolecule-positive, a cytotoxic effect of the cell-targeting molecule to members of said first population of cells relative to members of said second population of cells is at least 3-fold In certain embodiments, the cell-targeting molecule of the present invention is capable of inducing cellular internalization more efficiently than a reference molecule consisting of the cell-targeting molecule without any Shiga toxin effector polypeptide component(s). For certain further embodiments, administration of the cell-targeting molecule to a cell physically coupled with the extracellular target biomolecule results in one or more of the following: (1) internalizing the cell-targeting molecule inside the cell, (2) subcellular routing of a Shiga toxin effector polypeptide of the cell-targeting molecule to the cell's cytosol, (3) disrupting the cell's ribosome function, and (4) killing of the cell. For certain further embodiments, the internalizing occurs in about five hours, four hours, three hours, two hours, one hour, thirty minutes, or less at a physiological temperature appropriate for the cell and/or at about 37 degrees Celsius. For certain further embodiments, the cell-targeting molecule induces cellular internalization of a molecular complex comprising the cell-targeting molecule bound to the target biomolecule. For certain further embodiments, the cell is a target-positive cell. For certain embodiments, the cell is physically coupled with a significant amount of the extracellular target biomolecule.

For certain embodiments of Embodiment Set #3, the cell-targeting molecule of the present invention is capable when introduced to cells of exhibiting a cytotoxicity with a half-maximal inhibitory concentration ($CD_{50}$) value of 300 nM or less and/or capable of exhibiting a significant level of Shiga toxin cytotoxicity.

For certain embodiments of Embodiment Sets #3, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #3, the cell-targeting molecule further comprises a cytotoxic molecular moiety associated with the carboxy-terminus of the Shiga toxin effector polypeptide. For certain embodiments, the cytotoxic molecular moiety is a cytotoxic agent, such as, e.g., a small molecule chemotherapeutic agent, anti-neoplastic agent, cytotoxic antibiotic, alkylating agent, antimetabolite, topoisomerase inhibitor, and/or tubulin inhibitor known to the skilled worker and/or described herein. For certain further embodiments, the cytotoxic molecular moiety is cytotoxic at concentrations of less than 10,000, 5,000, 1,000, 500, or 200 pM.

In certain embodiments of Embodiment Set #3, the binding region is linked, either directly or indirectly, to the Shiga toxin effector polypeptide by at least one covalent bond which is not a disulfide bond. In certain further embodiments, the binding region is fused, either directly or indirectly, to the carboxy-terminus of the Shiga toxin effector polypeptide to form a single, continuous polypeptide. In certain further embodiments, the binding region is an immunoglobulin-type binding region.

In certain embodiments of Embodiment Set #3, the cell-targeting molecule of the present invention is capable when introduced to cells of exhibiting cytotoxicity comparable to a cytotoxicity of a reference molecule, such as, e.g., a reference cell-targeting molecule consisting of the cell-targeting molecule except for all of its Shiga toxin effector polypeptide component(s) each comprise a wild-type Shiga toxin A1 fragment.

In certain embodiments of Embodiment Set #3, the binding region sterically covers the carboxy-terminus of the A1 fragment region.

In certain embodiments of Embodiment Sets #3, the molecular moiety sterically covers the carboxy-terminus of the A1 fragment region. In certain further embodiments, the molecular moiety comprises the binding region.

In certain embodiments of Embodiment Set #3, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Sets #1 to #3, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #3, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

For certain embodiments of Embodiment Set #3, the cell-targeting molecule of the present invention exhibits low cytotoxic potency (i.e. is not capable when introduced to certain positive target cell types of exhibiting a cytotoxicity greater than 1% cell death of a cell population at a cell-targeting molecule concentration of 1000 nM, 500 nM, 100 nM, 75 nM, or 50 nM) and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., a reference cell-targeting molecule having an amino-terminus and comprising the binding region and the Shiga toxin effector polypeptide which is not positioned at or proximal to the amino-terminus of the reference cell-targeting molecule. In certain further embodiments, the reference cell-targeting molecule does not comprise any carboxy-terminal, endoplasmic reticulum retention/retrieval signal motif of the KDEL family.

Among certain embodiments of the present invention is a pharmaceutical composition comprising any one of the above Shiga toxin effector polypeptides of the present invention, any one of the above Shiga toxin effector polypeptide scaffolds of the present invention, and/or any one of the above cell-targeting molecules of the present invention; and at least one pharmaceutically acceptable excipient or carrier.

Among certain embodiments of the present invention is a diagnostic composition comprising any one of the above Shiga toxin effector polypeptides of the present invention, any one of the above Shiga toxin effector polypeptide scaffolds of the present invention, and/or cell-targeting molecules of the present invention and a detection promoting agent. Certain further embodiments are cell-targeting molecules of the present invention wherein the detection promoting agent is a heterologous epitope and the cell-targeting molecule comprises the heterologous epitope.

For certain embodiments, the cell-targeting molecule of the present invention is capable of exhibiting a cytotoxic activity with a $CD_{50}$ value of 1,000 nanomolar or less and/or a significant level of Shiga toxin cytotoxicity.

For certain embodiments of the cell-targeting molecule of the present invention, administration of the cell-targeting molecule to a target-expressing cell, the cell-targeting molecule is capable of causing death of the cell, i.e. killing the cell. For certain embodiments of the cell-targeting molecule of the present invention, upon administration of the cell-targeting molecule to a target-expressing cell expressing the extracellular target biomolecule, the cell-targeting molecule is capable of causing death of the cell. For certain further embodiments, the cell is a target biomolecule-positive cell. For certain further embodiments, the cell is physically coupled with a significant amount of the extracellular target biomolecule. This cell killing activity may or may not depend on the catalytic activity of one or more Shiga toxin effector polypeptides of the cell-targeting molecule.

In certain embodiments, the cell-targeting molecule of the present invention comprises only those immunoglobulin regions which lack free cysteine residues. In certain further embodiments, the cell-targeting molecule of the present invention comprises only those immunoglobulin regions which do not comprise any cysteine residues.

The embodiments of the present invention are not intended to cover any naturally-occurring Shiga holotoxin or Shiga toxin A Subunit. In certain embodiments of Embodiment Sets #1-3, the cell-targeting molecule of the present invention does not comprise a naturally occurring Shiga toxin B Subunit. In certain further embodiments, the cell-targeting molecule of the invention does not comprise any polypeptide comprising or consisting essentially of a functional binding domain of a native Shiga toxin B subunit. Rather, in certain embodiments of the cell-targeting molecules of the invention, the Shiga toxin A Subunit derived regions are functionally associated with heterologous binding regions to effectuate cell-targeting.

In certain embodiments of Embodiment Sets #1 to #3, the Shiga toxin effector polypeptide comprises at least two, embedded or inserted, heterologous epitopes.

In certain embodiments of Embodiment Sets #1 to #3, the Shiga toxin effector polypeptide does not comprise the set of amino acid residue substitutions relative to a wild-type Shiga toxin A Subunit selected from the following sets: (1) R248H and R251H; (2) R248G and R251G; (3) A246G, S247A, A253G, and S254A; and (4) A246G, S247A, R248G, R251G, A253G, and S254A.

In certain embodiments of Embodiment Sets #1 to #3, the Shiga toxin effector polypeptide does not comprise a deletion of the region natively positioned at 247-252 in a wild-type Shiga toxin A Subunit. In certain embodiments of Embodiment Sets #2-11, the Shiga toxin effector polypeptide does not comprise deletions of the regions natively positioned at 245-247 and 253-255 in a wild-type Shiga toxin A Subunit.

In certain embodiments, the molecule of the present invention does not comprise, at a position carboxy-terminal of the Shiga toxin effector polypeptide and/or the carboxy-terminus of the Shiga toxin A1 fragment region, any additional exogenous material representing an antigen and/or heterologous, CD8+, T-cell epitope-peptide.

In certain embodiments of Embodiment Set #3, the cell-targeting molecule of the present invention does not comprise a carboxy-terminal, binding region comprising a fragment of an immune cell surface receptor.

In certain embodiments of Embodiment Set #3, the binding region does not comprise a fragment of human CD4 corresponding to amino acid residues 19-183. In certain further embodiments, the binding region does not comprise a fragment of human CD4, a type-I transmembrane glycoprotein. In certain further embodiments, the binding region does not comprise a fragment of a human, immune cell surface co-receptor.

In certain embodiments of Embodiment Set #3, the binding region does not comprise a ligand. In certain embodiments of Embodiment Set #3, the binding region does not comprise a chemokine or a TNF-related apoptosis-inducing ligand (TRAIL) nor a receptor binding fragment thereof. In certain embodiments of Embodiment Set #3, the binding region does not comprise a human chemokine or human TRAIL nor a receptor binding fragment thereof. In embodiments of Embodiment Set #3, the immunoglobulin-type binding region does not comprise a ligand nor a receptor binding fragment thereof. In certain embodiments of Embodiment Set #3, the immunoglobulin-type binding region does not comprise a chemokine or a TNF-related apoptosis-inducing ligand (TRAIL) nor a receptor binding fragment thereof. In certain embodiments of Embodiment Set #3, the binding region does not comprise a human CC chemokine nor a receptor binding fragment thereof. In certain embodiments of Embodiment Sets #1 to #3, the binding region does not comprise the human CC chemokine CCL2 (see Bose S, Cho J et al., *Arch Pharm Res* 36: 1039-50 (2013)). In certain embodiments of Embodiment Sets #1 to #3, the binding region does not comprise the human, CC chemokine CCL2, nor a receptor binding fragment thereof, and a carboxy-terminal, Shiga toxin effector polypeptide consisting of amino acids 75-247 of StxA. In certain embodiments of the cell-targeting molecule of the present invention, the binding region does not comprise the human, CC chemokine CCL2, nor a receptor binding fragment thereof, fused to a carboxy-terminal, Shiga toxin effector polypeptide consisting of amino acids 75-247 of StxA (SEQ ID NO:2). In embodiments of Embodiment Set #3, the binding region does not comprise the human TRAIL nor a receptor binding fragment thereof.

In certain embodiments of Embodiment Sets #1 to #3, the Shiga toxin effector polypeptide does not comprise an amino acid substitution at native position 242 of SLT-1A (SEQ ID NO:1) or StxA (SEQ ID NO:2), or the equivalent position in a Shiga toxin effector polypeptide derived from either SLT-1A (SEQ ID NO:1) and/or StxA (SEQ ID NO:2). In certain embodiments of Embodiment Sets #1 to #3, the Shiga toxin effector polypeptide does not comprise any combination of: C242A, C261A, C242S, and/or C261S. In certain embodiments, the Shiga toxin effector polypeptide comprises all its endogenous, native cysteine residue(s) at their native positions or the equivalent position in a Shiga toxin effector polypeptide derived from SLT-1A (SEQ ID NO:1), StxA (SEQ ID NO:2), or SLT-2 (SEQ ID NO:3).

In certain embodiments of Embodiment Sets #1 to #3, wherein the Shiga toxin effector polypeptide and/or Shiga toxin effector polypeptide scaffold of the molecule of the invention is linked to a heterologous molecule (e.g. a cargo or cell-targeting molecule altering agent), the heterologous molecule is not linked to the free amine group of an amino-terminus of a polypeptide of the molecule of the present invention.

In certain embodiments of Embodiment Sets #1 to #3, wherein the Shiga toxin effector polypeptide and/or Shiga toxin effector polypeptide scaffold of the molecule of the invention is linked to a heterologous molecule (e.g. a cargo or cell-targeting molecule altering agent), the heterologous molecule is not linked to the free carboxyl group of a carboxy-terminus of a polypeptide of the molecule of the present invention.

In certain embodiments of Embodiment Sets #1 to #3, wherein the Shiga toxin effector polypeptide and/or Shiga toxin effector polypeptide scaffold of the molecule of the invention is linked via a unique amino acid residue's functional group to a heterologous molecule, the functional group is not an amine group or a carboxyl group.

In certain embodiments, the cell-targeting molecule of the present invention does not comprise an immunoglobulin Fc region or Fc region effector which retains an Fc region function, such as, e.g., involving extracellular signaling to immune system factors, cells, and/or tissues. Non-limiting examples of Fc region functions include activating T-cells, stimulating the release of inflammatory mediators such as cytokines like TNF-alpha, initiating complement dependent cytotoxicity (CDC), antibody-dependent cytotoxicity (ADCC), and phagocytosis of the cell bound extracellularly by the molecule comprising the Fc region.

In certain embodiments, the cell-targeting molecule of the present invention does not comprise any immunoglobulin heavy chain constant region, immunoglobulin light chain constant region, immunoglobulin CL domain, immunoglobulin $C_H1$ domain, immunoglobulin $C_H2$ domain, and/or immunoglobulin $C_H3$ domain. In certain further embodiments, the cell-targeting molecule does not comprise any immunoglobulin domains other than the immunoglobulin domains selected from (1) CDR, (2) ABR, and/or (3) any immunoglobulin domain present in an autonomous $V_H$ domain, single-domain antibody domains (sdAb), heavy-chain antibody domain fragment ($V_HH$ fragments or $V_H$ domain fragment), and single-chain variable fragment (scFv). In certain embodiments, the cell-targeting molecule of the present invention does not comprise any immunoglobulin domain or any polypeptide derived from an immunoglobulin.

For certain embodiments of the cell-targeting molecule, the cell-targeting molecule may be utilized for the delivery of additional exogenous material into a cell. In certain embodiments, the cell-targeting molecule of the present invention comprises a conjugated molecule representing an additional exogenous material. For certain embodiments of the cell-targeting molecule of the present invention, which comprises an additional exogenous material; whereby upon administration of the cell-targeting molecule to one or more cells physically coupled with the extracellular target biomolecule, the cell-targeting molecule internalizes into the one or more cells in about five hours, four hours, three hours, two hours, one hour, thirty minutes, or less at a physiological temperature appropriate for the cell and/or at about 37 degrees Celsius. For certain further embodiments, one or more cell(s) is a target-positive cell. For certain embodiments, one or more cell(s) is physically coupled with a significant amount of the extracellular target biomolecule.

For certain embodiments of the cell-targeting molecule of the present invention, which comprises an additional exogenous material; whereby upon administration of the cell-targeting molecule to one or more cells physically coupled with the extracellular target biomolecule, the cell-targeting molecule internalizes into the one or more cells and delivers the additional exogenous material into the interior of the cell in about five hours, four hours, three hours, two hours, one hour, thirty minutes, or less at a physiological temperature appropriate for the cell and/or at about 37 degrees Celsius. For certain further embodiments, one or more cell(s) is a target-positive cell. For certain embodiments, one or more cell(s) is physically coupled with a significant amount of the extracellular target biomolecule.

For certain embodiments of the cell-targeting molecule of the present invention, which comprises an additional exogenous material; whereby upon administration of the cell-targeting molecule to a plurality of cells physically coupled with the extracellular target biomolecule, at a concentration of cell-targeting molecule equivalent to five or thirty-eight percent to fifty percent cell-surface occupancy, the majority of the cell-targeting molecule internalizes into the plurality of cells in about five hours, four hours, three hours, two hours, one hour, thirty minutes, or less at a physiological temperature appropriate for the cell and/or at about 37 degrees Celsius. For certain further embodiments, members of the plurality of cells are target-positive cells. For certain embodiments, the members of the plurality of cells are physically coupled with a significant amount of the extracellular target biomolecule.

For certain embodiments of the cell-targeting molecule of the present invention, which comprises an additional exogenous material; whereby upon administration of the cell-targeting molecule to one or more cells physically coupled with the extracellular target biomolecule, the cell-targeting molecule internalizes into the one or more cells and delivers the additional exogenous material into the interior of the cell in about five hours, four hours, three hours, two hours, one hour, thirty minutes, or less at a physiological temperature appropriate for the cell and/or at about 37 degrees Celsius. For certain further embodiments, one or more cell(s) is a target-positive cell. For certain embodiments, one or more cell(s) is physically coupled with a significant amount of the extracellular target biomolecule.

For certain embodiments of the cell-targeting molecule of the present invention, which comprises an additional exogenous material; whereby upon administration of the cell-targeting molecule to a plurality of cells physically coupled with the extracellular target biomolecule, at a concentration of cell-targeting molecule equivalent to five or thirty-eight percent to fifty percent cell-surface occupancy, the majority of the cell-targeting molecule internalizes into the plurality of cells and delivers the additional exogenous material into the interiors of the cells in about five hours, four hours, three hours, two hours, one hour, thirty minutes, or less at a physiological temperature appropriate for the cell and/or at about 37 degrees Celsius. For certain further embodiments, members of the plurality of cells are target-positive cells. For certain embodiments, the members of the plurality of cells are physically coupled with a significant amount of the extracellular target biomolecule.

In certain embodiments, the cell-targeting molecule of the present invention comprises a conjugated molecule representing an additional exogenous material selected from the group consisting of: antibiotic, cytotoxic agent, detection-promoting agent, peptide, polypeptide, protein, polynucleotide, and/or protein-nucleic acid complex. In certain further embodiments, the additional exogenous material is the protein comprising an enzyme. In certain other embodiments, the additional exogenous material is the polynucleotide which functions as a small inhibiting RNA (siRNA) or microRNA (miRNA). In certain embodiments, the additional exogenous material is the peptide which is an antigen, such as, e.g., from a pathogen. In certain embodiments, the antigen is derived from a molecule selected from the group consisting of: bacterial protein, protein mutated in cancer, protein aberrantly expressed in cancer, T-cell complementary determining region polypeptide, and/or viral protein. In certain embodiments, the cytotoxic agent is a chemotherapeutic agent, cytotoxic antibiotic, alkylating agent, antimetabolite, topoisomerase inhibitor, and/or tubulin inhibitor.

The present invention also provides pharmaceutical compositions comprising a Shiga toxin effector polypeptide of the present invention and/or a cell-targeting molecule of the present invention, and comprising at least one pharmaceutically acceptable excipient or carrier; and the use of such a cell-targeting molecule or a composition comprising it in making such pharmaceutical compositions and in methods of the present invention as further described herein. Certain embodiments of the present invention are pharmaceutical compositions comprising any cell-targeting molecule of the present invention and at least one pharmaceutically acceptable excipient or carrier.

Among certain embodiments of the present invention is a diagnostic composition comprising a cell-targeting molecule of the present invention that further comprises a detection-promoting agent for the collection of information about a cell, cell type, tissue, organ, disease, disorder, condition, subject, and/or patient.

Beyond the Shiga toxin effector polypeptides and cell-targeting molecules of the present invention, and compositions thereof, polynucleotides capable of encoding a Shiga toxin effector polypeptide and/or a cell-targeting molecule of the present invention, or polypeptide component thereof, are within the scope of the present invention, as well as expression vectors which comprise a polynucleotide of the invention and host cells comprising an expression vector of the present invention. Host cells comprising an expression vector of the present invention may be used, e.g., in methods for producing a cell-targeting molecule of the present invention or a polypeptide component or fragment thereof by recombinant expression. Similarly, host cells comprising an expression vector of the present invention may be used, e.g., in methods for producing a composition of the present invention, or a polypeptide component thereof.

The present invention also encompasses any composition of matter of the present invention which is immobilized on a solid substrate. Such arrangements of the compositions of matter of the present invention may be utilized, e.g., in methods of screening molecules as described herein.

Additionally, the present invention provides methods of killing cell(s) comprising the step of contacting a cell(s) with a cell-targeting molecule of the present invention and/or a pharmaceutical composition of the present invention. For certain embodiments, the step of contacting the cell(s)

occurs in vitro. For certain other embodiments, the step of contacting the cell(s) occurs in vivo. For certain embodiments of the cell-killing methods of the present invention, the method is capable of selectively killing cell(s) and/or cell types preferentially over other cell(s) and/or cell types when contacting a mixture of cells comprising different cells which differ with respect to the cell-surface presence and/or expression level of an extracellular target biomolecule bound by the binding regions of the cell-targeting molecule.

In addition, the present invention provides a method of inducing cellular internalization of a cell-targeting molecule into a cell(s) physically coupled with the extracellular target biomolecule, the method comprising the step of contacting the cell(s) with a cell-targeting molecule of the present invention, a pharmaceutical composition of the present invention, and/or a diagnostic composition of the present invention. For certain further embodiments of the inducing cellular internalization method, the step of contacting the cell(s) occurs in vitro. For certain other embodiments, the step of contacting the cell(s) occurs in vivo, such as, e.g., within a patient. For certain further embodiments of the inducing cellular internalization method, the cellular internalization of the cell-targeting molecule occurs in about five hours, four hours, three hours, two hours, one hour, thirty minutes, or less at a physiological temperature appropriate for the cell and/or at about 37 degrees Celsius. For certain further embodiments, the cell is a target-positive cell. For certain embodiments, the cell is physically coupled with a significant amount of the extracellular target biomolecule.

For certain embodiments, the present invention provides a method of inducing cellular internalization of a cell-targeting molecule into a plurality of cells physically coupled with the extracellular target biomolecule, the method comprising the step of contacting the plurality of cells with a cell-targeting molecule of the present invention, a pharmaceutical composition of the present invention, and/or a diagnostic composition of the present invention. For certain further embodiments of the inducing cellular internalization method, the step of contacting the cell(s) occurs in vitro. For certain other embodiments, the step of contacting the cell(s) occurs in vivo, such as, e.g., within a patient. For certain further embodiments of the inducing cellular internalization method, the cellular internalization of the cell-targeting molecule occurs in about five hours, four hours, three hours, two hours, one hour, thirty minutes, or less at a physiological temperature appropriate for the cell and/or at about 37 degrees Celsius. For certain embodiments, the members of the plurality of cells are physically coupled with a significant amount of the extracellular target biomolecule.

Similarly, the present invention provides a method of internalizing a cell surface localized target bound by a cell-targeting molecule of the present invention, the method comprising the step of contacting a cell(s) having cell surface localized target biomolecule, with a cell-targeting molecule of the present invention, pharmaceutical composition of the present invention, and/or a diagnostic composition of the present invention. For certain further embodiments of the method of internalizing cell surface localized target, the step of contacting the cell(s) occurs in vitro. For certain other embodiments, the step of contacting the cell(s) occurs in vivo, such as, e.g., within a patient. For certain further embodiments of the of the method of internalizing cell surface localized target, the internalization of cell surface localized target biomolecule occurs in about five hours, four hours, three hours, two hours, one hour, thirty minutes, or less at a physiological temperature appropriate for the cell and/or at about 37 degrees Celsius. For certain further embodiments, the cell is a target-positive cell. For certain embodiments, the cell is physically coupled with a significant amount of the extracellular target biomolecule.

For certain embodiments, the present invention provides a method of internalizing a cell surface localized target biomolecule bound by a cell-targeting molecule of the present invention, the method comprising the step of contacting a plurality of cells having cell surface localized target biomolecule with a cell-targeting molecule of the present invention, pharmaceutical composition of the present invention, and/or a diagnostic composition of the present invention. For certain further embodiments of the method of internalizing cell surface localized target biomolecule, the step of contacting the plurality of cells occurs in vitro. For certain other embodiments, the step of contacting the plurality of cells occurs in vivo, such as, e.g., within a patient. For certain further embodiments of the of the method of internalizing cell surface localized target biomolecule, the internalization of cell surface localized target biomolecule occurs in a majority of the cells of the plurality of cells in about five hours, four hours, three hours, two hours, one hour, thirty minutes, or less at a physiological temperature appropriate for the cell and/or at about 37 degrees Celsius. For certain further embodiments, members of the plurality of cells are target-positive cells. For certain embodiments, the members of the plurality of cells are physically coupled with a significant amount of the extracellular target biomolecule.

For certain embodiments, the present invention provides a method of inducing cellular internalization of a cell surface localized target biomolecule bound by a cell-targeting molecule in a subject, the method comprising the step of administering to the subject a cell-targeting molecule of the present invention, pharmaceutical composition of the present invention, and/or a diagnostic composition of the present invention.

Additionally, the present invention provides a method for delivering an exogenous material to the inside of a cell, the method comprising the step of contacting the cell(s), either in vitro or in vivo, with a cell-targeting molecule of the present invention which comprises an additional exogenous material, a pharmaceutical composition of the present invention comprising a cell-targeting molecule of the present invention which comprises an additional exogenous material, and/or a diagnostic composition of the present invention comprising a cell-targeting molecule of the present invention which comprises an additional exogenous material. For certain further embodiments, the cell is physically coupled with the extracellular target biomolecule. For certain further embodiments, the cell is a target-positive cell. For certain embodiments, the cell is physically coupled with a significant amount of the extracellular target biomolecule.

For certain embodiments, the present invention provides a method of delivering an exogenous material to the inside of a cell, the method comprising the step of administering to a subject a cell-targeting molecule of the present invention which comprises an additional exogenous material, a pharmaceutical composition of the present invention comprising a cell-targeting molecule of the present invention which comprises an additional exogenous material, and/or a diagnostic composition of the present invention comprising a cell-targeting molecule of the present invention which comprises an additional exogenous material. For certain further embodiments, the cell is physically coupled with the extracellular target biomolecule. For certain further embodiments, the cell is a target-positive cell. For certain embodiments, the cell is physically coupled with a significant amount of the extracellular target biomolecule.

For certain further embodiments, the cell, cells, and population of cells referred to as (1) “cell”; (2) “cell physically coupled with target biomolecule”; (3) “cell expressing, at a cellular surface, target biomolecule”; (4) “target-positive cell”; (5) “plurality of cells”; (6) “plurality of cells physically coupled with target biomolecule”; (7) “population of cells”; (8) “population of target-positive cells”; or (9) “one or more cells” are a cell, cells, or population of cells that (a) is physically coupled with extracellular target biomolecule; (b) expresses at a cellular surface the target biomolecule which (i) have the extracellular part bound by the binding region of the cell-targeting molecule, (ii) have a transmembrane domain, and (iii) remain physically coupled to the cell(s); (c) is a target-positive; and/or (d) is physically coupled with a significant amount of extracellular target biomolecule which have the extracellular part bound by the binding region of the cell-targeting molecule.

The use of any composition of the present invention for the diagnosis, prognosis, and/or characterization of a disease, disorder, and/or condition is within the scope of the present invention. Among certain embodiments of the present invention is the use of one or more compositions of matter of the present invention (e.g. a pharmaceutical composition of the present invention) in the treatment or prevention of a cancer, tumor, abnormal growth condition, and/or immune disorder. Among certain embodiments of the present invention is the use of one or more compositions of matter of the invention (e.g. a pharmaceutical composition of the present invention) in the manufacture of a medicament for the treatment or prevention of a cancer, tumor, abnormal growth condition, and/or immune disorder.

The present invention further provides methods of treating diseases, disorders, and/or conditions in subjects, the method comprising the step of administering to a subject in need thereof a therapeutically effective amount of a cell-targeting molecule of the present invention and/or a pharmaceutical composition of the present invention. For certain embodiments of these treatment methods of the invention, the disease, disorder, or condition to be treated using a method of the invention involves a cell, cancer cell, tumor cell, and/or immune cell which express target biomolecule at a cellular surface. For certain embodiments of these treatment methods of the invention, the disease, disorder, or condition to be treated using a method of the invention is a cancer, tumor, abnormal growth condition, and/or immune disorder. For certain embodiments of these treatment methods of the invention, the disease to be treated is selected from the group consisting of: bone cancer (such as multiple myeloma or Ewing’s sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi’s sarcoma, or synovial sarcoma), skin cancer (such as basal cell carcinoma, squamous cell carcinoma, or melanoma), uterine cancer, AIDS, amyloidosis, ankylosing spondylitis, asthma, autism, cardiogenesis, Crohn’s disease, diabetes, erythematosus, gastritis, graft rejection, graft-versus-host disease (GVHD), Grave’s disease, Hashimoto’s thyroiditis, hemolytic uremic syndrome, HIV-related diseases, lupus erythematosus, lymphoproliferative disorders, multiple sclerosis, myasthenia gravis, neuroinflammation, polyarteritis, psoriasis, psoriatic arthritis, rheumatoid arthritis, scleroderma, septic shock, Sjögren’s syndrome, systemic lupus erythematosus, ulcerative colitis, vasculitis, cell proliferation, inflammation, leukocyte activation, leukocyte adhesion, leukocyte chemotaxis, leukocyte maturation, leukocyte migration, neuronal differentiation, acute lymphoblastic leukemia (ALL), T acute lymphocytic leukemia/lymphoma (ALL), acute myelogenous leukemia, acute myeloid leukemia (AML), B-cell chronic lymphocytic leukemia (B-CLL), B-cell prolymphocytic lymphoma, Burkitt’s lymphoma (BL), chronic lymphocytic leukemia (CLL), chronic myelogenous leukemia (CIVIL-BP), chronic myeloid leukemia (CIVIL), diffuse large B-cell lymphoma, follicular lymphoma, hairy cell leukemia (HCL), Hodgkin’s Lymphoma (HL), intravascular large B-cell lymphoma, lymphomatoid granulomatosis, lymphoplasmacytic lymphoma, MALT lymphoma, mantle cell lymphoma, multiple myeloma (MM), natural killer cell leukemia, nodal marginal B-cell lymphoma, Non-Hodgkin’s lymphoma (NHL), plasma cell leukemia, plasmacytoma, primary effusion lymphoma, pro-lymphocytic leukemia, promyelocytic leukemia, small lymphocytic lymphoma, splenic marginal zone lymphoma, T-cell lymphoma (TCL), heavy chain disease, monoclonal gammopathy, monoclonal immunoglobulin deposition disease, myelodusplastic syndromes (MDS), smoldering multiple myeloma, and Waldenstrom macroglobulinemia. For certain embodiments of these treatment methods of the invention, the disease to be treated is selected from the group consisting of: hematologic cancer, leukemia, lymphoma, melanoma, and myeloma. For certain embodiments of these treatment methods of the invention, the immune disorder to be treated is selected from the group consisting of: amyloidosis, ankylosing spondylitis, asthma, Crohn’s disease, diabetes, graft rejection, graft-versus-host disease, Graves’ disease, Graves’ ophthalmopathy, Hashimoto’s thyroiditis, hemolytic uremic syndrome, HIV-related diseases, lupus erythematosus, multiple sclerosis, neuromyelitis optica spectrum disorders, N-methyl D-aspartate (NMDA) receptor encephalitis, opsoclonus myoclonus syndrome (OMS), paroxysmal nocturnal hemoglobinuria, polyarteritis nodosa, polyarthritis, psoriasis, psoriatic arthritis, rheumatoid arthritis, scleritis, scleroderma, septic shock, Sjögren’s syndrome, ulcerative colitis, and vasculitis. For certain embodiments of these treatment methods of the present invention, the cancer to be treated is selected from the group consisting of: acute myeloid leukemia (acute myelogenous leukemia or AML), acute non-lymphocytic leukemia, B-cell chronic lymphocytic leukemia (B-cell CLL), B-cell lymphoma, B-cell non-Hodgkin’s lymphoma (B-cell NHL), B-cell precursor acute lymphoblastic leukemia (BCP-ALL or B-ALL), B-cell prolymphocytic leukemia (B-PLL), Burkitt’s lymphoma (BL), chronic lymphocytic leukemia (CLL), chronic myeloid leukemia (CIVIL), diffuse large B-cell lymphoma (DLBCL or DLBL), follicular lymphoma (FL), hairy cell leukemia (HCL), Hodgkin’s lymphoma (HL or HD), immunoblastic large cell lymphoma, mantle cell lymphoma (MCL), multiple myeloma (MM), nodular lymphocyte predominant Hodgkin’s lymphoma (NLPHL), non-Hodgkin’s lymphoma (NHL), plasmablastic lymphoma, plasma cell neoplasma, plasma cell myeloma, precursor B-lymphoblastic lymphoma (B-LBL), small lymphocytic lymphoma (SLL), T-cell large granular lymphocyte leukemia (T-LGLL), T-cell lymphoma (TCL), T-cell pro-lymphocytic leukemia (T-PLL), and Waldenstrom's macro-globulinemia (WM).

Among certain embodiments of the present invention is a method of producing a cell-targeting molecule of the present invention and/or Shiga toxin effector polypeptide conjugate, the method comprising the step of conjugating a cell-targeting molecule or Shiga toxin effector polypeptide of the present invention to a heterologous molecule and/or additional exogenous material.

Among certain embodiments of the present invention is a method of using a cell-targeting molecule of the present invention comprising a detection-promoting agent for the collection of information useful in the diagnosis, prognosis, or characterization of a disease, disorder, or condition. Among certain embodiments of the present invention is a method of detecting a cell using a cell-targeting molecule and/or diagnostic composition of the invention, the method comprising the steps of contacting a cell with the cell-targeting molecule and/or diagnostic composition of the invention and detecting the presence of the cell-targeting molecule and/or diagnostic composition. For certain embodiments, the step of contacting the cell(s) occurs in vitro and/or ex vivo. For certain embodiments, the step of contacting the cell(s) occurs in vivo. For certain embodiments, the step of detecting the cell(s) occurs in vitro and/or ex vivo. For certain embodiments, the step of detecting the cell(s) occurs in vivo. For certain further embodiments, the information is useful in the diagnosis, prognosis, or characterization of one or more of the following: bone cancer (such as multiple myeloma or Ewing's sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi's sarcoma, or synovial sarcoma), skin cancer (such as basal cell carcinoma, squamous cell carcinoma, or melanoma), uterine cancer, AIDS, amyloidosis, ankylosing spondylitis, asthma, autism, cardiogenesis, Crohn's disease, diabetes, erythematosus, gastritis, graft rejection, graft-versus-host disease, Grave's disease, Hashimoto's thyroiditis, hemolytic uremic syndrome, HIV-related diseases, lupus erythematosus, lymphoproliferative disorders, multiple sclerosis, myasthenia gravis, neuroinflammation, polyarteritis, psoriasis, psoriatic arthritis, rheumatoid arthritis, scleroderma, septic shock, Sjögren's syndrome, systemic lupus erythematosus, ulcerative colitis, vasculitis, cell proliferation, inflammation, leukocyte activation, leukocyte adhesion, leukocyte chemotaxis, leukocyte maturation, leukocyte migration, neuronal differentiation, acute lymphoblastic leukemia (ALL), T acute lymphocytic leukemia/lymphoma (ALL), acute myelogenous leukemia, acute myeloid leukemia (AML), B-cell chronic lymphocytic leukemia (B-CLL), B-cell prolymphocytic lymphoma, Burkitt's lymphoma (BL), chronic lymphocytic leukemia (CLL), chronic myelogenous leukemia (CIVIL-BP), chronic myeloid leukemia (CML), diffuse large B-cell lymphoma, follicular lymphoma, hairy cell leukemia (HCL), Hodgkin's Lymphoma (HL), intravascular large B-cell lymphoma, lymphomatoid granulomatosis, lymphoplasmacytic lymphoma, MALT lymphoma, mantle cell lymphoma, multiple myeloma (MM), natural killer cell leukemia, nodal marginal B-cell lymphoma, Non-Hodgkin's lymphoma (NHL), plasma cell leukemia, plasmacytoma, primary effusion lymphoma, pro-lymphocytic leukemia, promyelocytic leukemia, small lymphocytic lymphoma, splenic marginal zone lymphoma, T-cell lymphoma (TCL), heavy chain disease, monoclonal gammopathy, monoclonal immunoglobulin deposition disease, myelodusplastic syndromes (MDS), smoldering multiple myeloma, and Waldenstrom macroglobulinemia.

Among certain embodiments of the present invention are kits comprising a composition of matter of the present invention, and optionally, instructions for use, additional reagent(s), and/or pharmaceutical delivery device(s). The kit may further comprise reagents and other tools for detecting a cell type (e.g. a tumor cell) in a sample or in a subject.

These and other features, aspects and advantages of the present invention will become better understood with regard to the following description, appended claims, and accompanying figures. The aforementioned elements of the invention may be individually combined or removed freely in order to make other embodiments of the invention, without any statement to object to such combination or removal hereinafter.

BRIEF DESCRIPTION OF THE FIGURES

FIG. 1-A and FIG. 1-B depict exemplary, Shiga toxin A Subunit effector polypeptides of the present invention; cell-targeting molecules comprising the same; cell-targeting molecules comprising a linker and/or cell-targeting binding region of the present invention; and conjugate-linked cell-targeting molecules of the present invention. The depictions of exemplary molecules in FIG. 1-A and FIG. 1-B are for illustrative purposes of certain, general arrangements of the structural features of a limited set of embodiments of the present invention. It is to be understood that these exemplary molecules do not intend, nor should any be construed, to be wholly definitive as to the arrangement of any structural features and/or components of a molecule of the present invention. The relative size, location, or number of features shown in the schematics of FIG. 1-A and FIG. 1-B have been simplified. For example, the relative positions of the X, Y, and Z features are not fixed. Similarly, the total numbers of the X, Y, and Z features are not fixed. The schematics in FIG. 1-A and FIG. 1-B are not intended to accurately portray any information regarding the relative sizes of molecular structures in any embodiment of the present invention, e.g., the relative size of Y or Z to the Shiga toxin effector polypeptide and/or cell-targeting molecule or the relative size of the linker to the Shiga toxin effector domain to the cell-targeting binding domain. FIG. 1-A depicts Shiga toxin A Subunit effector domains with one or more engineered amino acid residues for site-specific conjugation, such as, e.g., a cysteine, lysine, and/or histidine residue(s). In FIG. 1-A, an "X" represents a position-ectopic and/or unique amino acid residue relative to wild-type Shiga toxins that has been engineered into the Shiga toxin effector domain but which does not impair the required function(s) of the Shiga toxin effector domain. FIG. 1-A also depicts Shiga toxin A Subunit effector domains conjugated to one or more molecules (labeled "Y" or "Z"), such as, e.g., a cargo(s) like a drug or property-altering agent(s) like serum albumin and/or polyethylene glycol molecule(s). FIG. 1-B depicts exemplary cell-targeting molecules of the present invention, each comprising one or more amino acid residues for site specific conjugation, such as where the residue is located in the Shiga toxin effector domain, linker, and/or cell-targeting binding domain. As in FIG. 1-A, FIG. 1-B also depicts molecules conjugated to one or more other molecules labeled "Y" or "Z", such as, e.g., a cargo(s) like a drug or property-altering agent(s) like serum albumin and/or polyethylene glycol molecule(s). The "X" in FIG. 1-B represents an amino acid residue that has been engineered into the molecule for site-specific conjugation and/or for which other amino acid residues of the same type have been engineered out of the molecule for uniqueness, such as, e.g., a site-specific cysteine, lysine, histidine, or selenocysteine residue but which does not impair the required function(s) of the cell-targeting molecule.

FIG. 2 graphically shows that exemplary cell-targeting molecules of the present invention SLT-1A-Cys(p)::scFv1 exhibited potent and specific cell-targeted cytotoxicity. The percent viability of cells for each cell line was plotted over the logarithm to base 10 of the cell-targeting molecule concentration administered to the respective cells (in nM). FIG. 2 shows that the cell-targeting molecules of the present invention SLT-1A-Cys(p)::scFv1 did not exhibit cytotoxicity to a target negative cell type at the concentrations tested. The cytotoxicity results from this assay for an untargeted, wild-type Shiga toxin A1 fragment are shown as well.

FIG. 3 graphically shows that the exemplary cell-targeting molecules of the present invention SLT-1A-Cys(p)-D1::scFv2 exhibited potent cytotoxicity which was comparable to the cytotoxic potency of the reference molecule SLT-1A-D1::scFv2 (SEQ ID NO:838). The percent viability of cells was plotted over the logarithm to base 10 of the cell-targeting molecule concentration administered to the cells (in nM). The cytotoxicity results from this assay for an untargeted, de-immunized, Shiga toxin A1 fragment having zero cysteine residues are shown as well.

FIG. 4 graphically shows that the exemplary cell-targeting molecules of the present invention SLT-1A-D1::linker-Cys1::scFv2 (SEQ ID NO:803), SLT-1A-D1::scFv2-linker-Cys1 (SEQ ID NO:807), and SLT-1A-D1::scFv2-Binding Domain-Cys2 (SEQ ID NO:812) exhibited cytotoxicity to a target-positive cell type comparable to the reference cell-targeting molecule SLT-1A-D1::scFv2 (SEQ ID NO:838). The percent viability of cells was plotted over the logarithm to base 10 of the cell-targeting molecule concentration administered to the cells (in nM). The cytotoxicity results from this assay for an untargeted, de-immunized, Shiga toxin A1 fragment having zero cysteine residues are shown as well.

FIGS. 5-6 show pictures of replicate, COOMASSIE-stained, sodium dodecyl sulfate (SDS), polyacrylamide gels after electrophoresis of either reduced or non-reduced samples in order to analyze the presence of non-covalent versus covalent-reducible species present in various samples. In FIGS. 5-6, the left side shows COOMASSIE-stained SDS-PAGE gels run under reducing and denaturing conditions, and the right side shows replicate, COOMASSIE-stained SDS-PAGE gels run under non-reducing, denaturing conditions. The Figure legends list the samples loaded and run in each lane of the replicate gels. The first lane marked "MW Marker" shows the migration pattern of a protein molecular weight ladder, and the approximate size of each ladder protein band is labeled in kiloDaltons (kDa). The molecular weight bands representing larger molecules that are visible in the non-reduced gels but not the reduced gels indicate that reducible, disulfide bonds formed between protein species in the sample. This is indicative of the availability of the unique cysteine residue of one molecule to bond intermolecularly with another unique cysteine residue of second molecule to form homodimers and multimeric complexes.

FIG. 5 shows the sizes of different proteinaceous species present in exemplary cell-targeting molecule compositions of the present invention analyzed by gel electrophoresis of proteinaceous molecules present in different, exemplary compositions of the present invention. In FIG. 5, the samples loaded and run in lanes numbered 2-6 are indicated in the figure legend (lane number #n) preparation of cell-targeting molecule name-x): #2) SLT-1A-D1::scFv3 (SEQ ID NO:839), #3) SLT-1A-D1-C242::scFv3 (SEQ ID NO:837), #4) SLT-1A-Cys5-D1::scFv3 (SEQ ID NO:778), #5) SLT-1A-Cys3-D1::scFv3 (SEQ ID NO:779), and #6) SLT-1A-Cys2-D1::scFv3 (SEQ ID NO:780).

FIG. 6 shows the sizes of different proteinaceous species present in exemplary cell-targeting molecule compositions of the present invention analyzed by gel electrophoresis of proteinaceous molecules present in different, exemplary compositions of the present invention. In FIG. 6, the samples loaded and run in lanes numbered 2-10 are indicated in the figure legend (lane number #n) preparation of cell-targeting molecule name-x): #2) SLT-1A-Cys2-D1::scFv2 (SEQ ID NO:773), #3) SLT-1A-Cys6-D1::scFv2 (SEQ ID NO:774), #4) SLT-1A-Cys8-D1::scFv2 (SEQ ID NO:776), #5) SLT-1A-Cys9-D1::scFv2 (SEQ ID NO:777), #6) SLT-1A-D1::linker-Cys1::scFv2 (SEQ ID NO:803), #7) SLT-1A-D1::scFv2-linker-Cys1 (SEQ ID NO:807), #8) SLT-1A-D1::scFv2-Cys-C2 (SEQ ID NO:812), #9) SLT-1A-Cys7-D1::scFv2 (SEQ ID NO:775), and #10) SLT-1A-D1::scFv2 (SEQ ID NO:838). FIG. 6 shows that the SLT-1A-Cys2-D1::scFv2 (SEQ ID NO:773) sample analyzed was comprised predominantly by non-covalent dimeric complexes and that the protein in the SLT-1A-Cys7-D1::scFv2 (SEQ ID NO:775) sample was predominantly comprised by redox-sensitive.

FIG. 7 graphically shows the sizes of different molecular species present in a sample of an exemplary composition of the present invention comprising the exemplary cell-targeting molecule of the present invention SLT-1A-Cys2-D1::scFv2 (SEQ ID NO:773) as analyzed by size exclusion chromatography (SEC). FIG. 7 shows the absorbance of ultraviolet light at 280 nanometers (nm) of the material eluted after flowing through a SEC column in milli-absorbance units (mAU) plotted over the elution volume (mL), indicated by the labeling under the x-axis. The numbering above the x-axis indicated the fraction number. In addition, FIG. 7 shows the cell-targeting molecule purity of this exemplary composition of the present invention as analyzed by SEC.

FIG. 8 graphically shows the sizes of different molecular species present in a sample of an exemplary composition of the present invention comprising the exemplary cell-targeting molecule of the present invention SLT-1A-Cys7-D1::scFv2 (SEQ ID NO:775) as analyzed by size exclusion chromatography (SEC). FIG. 7 shows the absorbance of ultraviolet light at 280 nanometers (nm) of the material eluted after flowing through a SEC column in milli-absorbance units (mAU) plotted over the elution volume (mL), indicated by the labeling under the x-axis. The numbering above the x-axis indicates the fraction number. In addition, FIG. 8 shows the cell-targeting molecule purity of this exemplary composition of the present invention as analyzed by SEC.

FIGS. 9-11 graphically show fluorescence-activated cell sorting (FACS) profile overlays of cell samples treated with exemplary, cargo-linked cell-targeting molecules of the present invention or control molecules. The cell count or "events" (y-axis) was plotted against the fluorescent intensity in relative fluorescent units (RFU) (x-axis) detect by the FACS FL1-A channel measured as mean fluorescent intensity (MFI). The black line shows the data from the cells treated with a cargo-linked cell-targeting molecule or antibody control, and the gray line shows the data from the negative cell population (isotype control sample). FIGS. 9-10 show that variants of cargo-linked SLT-1A-Cys5-D1::scFv2 (SEQ ID NO:789), whether catalytically active or impaired, bound to target-2 positive cells of two different cell-types. In addition, FIGS. 9-10 show that variants of cargo-linked SLT-1A-Cys5-D1::scFv2 (SEQ ID NO:789), whether catalytically active or impaired, bound to target-2 positive cells with similar characteristics as the monoclonal antibody positive control "anti-target2 mAb-FITC". FIG. 11 shows that variants of cargo-linked SLT-1A-Cys5-D1::scFv2 (SEQ ID NO:789), whether catalytically active or impaired, bound to target-2 negative cells comparable to the isotype negative control, i.e. these molecules did not show specific binding to this cell type.

FIG. 12-14 show microscopy images of the localization of dye-linked cell-targeting molecules of the present invention SLT-1A-Cys5-D1::scFv2_ALEXA-555 and IA-SLT-1A-Cys5-D1::scFv2_ALEXA-555 after administration to different cell types. The images are merged images of two fluorescent signals, one to detect the emission of 4',6-diamidino-2-phenylindole (DAPI) shown in blue and one to detect the emission of Alexa Fluor® 555 (ALEXA-555) shown in red. In FIG. 12, the cells tested were target-2 positive cells of Cell Line C. In FIG. 13, the cells tested were target-2 positive cells of Cell Line G. The images in FIGS. 12-13 show both cell-targeting molecules entered target cells within one hour of administration of two target-2 positive cell-types, cells of Cell Line C and Cell Line G. In FIG. 14, the cells tested were target-2 negative cells of Cell Line H. FIG. 14 shows that these cell-targeting molecules neither bound to nor entered target negative cells in detectable amounts under the conditions tested.

FIG. 15 shows a picture of a COOMASSIE-stained, SDS polyacrylamide gel after electrophoresis of an exemplary cell-targeting molecule of the present invention (SLT-1A-Cys5-D1::scFv2) before and after conjugation of a cargo molecule. The Figure legends list the samples loaded and run in each lane of the gel. The first and last lanes show the migration pattern of a protein molecular weight ladder, and the approximate size of each ladder protein band is labeled in kDa on the left side. Lane #4 shows the cell-targeting molecule alone and lanes #3 and #5 show the same cell-targeting molecule linked to two different cargos.

FIG. 16 graphically shows that exemplary cell-targeting molecules of the present invention SLT-1A-Cys5-D1::scFv2 (SEQ ID NO:789), whether cargo-linked or not, exhibited potent and specific cell-targeted cytotoxicity comparable to the cytotoxic potency and specificity of the reference molecule SLT-1A-D1::scFv2 (SEQ ID NO:838). The percent viability of cells for each cell line was plotted over the logarithm to base 10 of the cell-targeting molecule concentration administered to the respective cells (in ng/mL). FIG. 16 shows that the cell-targeting molecules of the present invention SLT-1A-Cys5-D1::scFv2 (SEQ ID NO:789), whether cargo-linked or not, did not exhibit cytotoxicity to a target negative cell type at the concentrations tested, similar to the reference molecule SLT-1A-D1::scFv2 (SEQ ID NO:838).

FIG. 17 graphically shows that exemplary cell-targeting molecules of the present invention SLT-1A-Lys1-D3-variant-1::scFv4 (SEQ ID NO:818), SLT-1A-Lys1-D3-variant-2::scFv4 (SEQ ID NO:819), SLT-1A-Lys1-D3-variant4::scFv4 (SEQ ID NO:820), SLT-1A-Lys2-D3-variant-1::scFv4 (SEQ ID NO:821), SLT-1A-Lys2-D3-variant2::scFv4 (SEQ ID NO:822), and SLT-1A-Lys2-D3-variant-5::scFv4 (SEQ ID NO:823) exhibited potent and specific cell-targeted cytotoxicity comparable to the cytotoxic potency and specificity of the reference molecule SLT-1A-D3::scFv4 (SEQ ID NO:828). In addition, FIG. 17 graphically shows that exemplary cell-targeting molecules of the present invention SLT-1A-Lys(null)-D3-variant-21::scFv4 (SEQ ID NO:824), SLT-1A-Lys(null)-D3-variant-27::scFv4 (SEQ ID NO:825), and SLT-1A-Lys(null)-D3-variant-40::scFv4 (SEQ ID NO:826) exhibited potent and specific cell-targeted cytotoxicity comparable to the cytotoxic potency and specificity of the reference molecule SLT-1A-D3::scFv4 (SEQ ID NO:828). The percent viability of cells for each cell line was plotted over the logarithm to base 10 of the cell-targeting molecule concentration administered to the respective cells (in ng/mL).

FIG. 18 shows that the cell-targeting molecules of the present invention SLT-1A-Lys1-D3-variant-1::scFv4 (SEQ ID NO:818), SLT-1A-Lys1-D3-variant-2::scFv4 (SEQ ID NO:819), SLT-1A-Lys1-D3-variant4::scFv4 (SEQ ID NO:820), SLT-1A-Lys2-D3-variant-1::scFv4 (SEQ ID NO:821), SLT-1A-Lys2-D3-variant2::scFv4 (SEQ ID NO:822), SLT-1A-Lys2-D3-variant-5::scFv4 (SEQ ID NO:823), SLT-1A-Lys(null)-D3-variant-21::scFv4 (SEQ ID NO:824), SLT-1A-Lys(null)-D3-variant-27::scFv4 (SEQ ID NO:825), and SLT-1A-Lys(null)-D3-variant-40::scFv4 (SEQ ID NO:826) did not exhibit cytotoxicity to a target negative cell type at the concentrations tested, similar to the reference molecule SLT-1A-D3::scFv4 (SEQ ID NO:828). The percent viability of cells for each cell line was plotted over the logarithm to base 10 of the cell-targeting molecule concentration administered to the respective cells (in ng/mL).

FIG. 19 graphically shows that exemplary cell-targeting molecules of the present invention SLT-1A-Lys(null)-D4-variant-42::scFv4 (SEQ ID NO:827) exhibited potent and specific cell-targeted cytotoxicity comparable to the cytotoxic potency and specificity of the reference molecules SLT-1A-D3::scFv4 (SEQ ID NO:828) and SLT-1A-D5::scFv4 (SEQ ID NO:829). The percent viability of cells for each cell line was plotted over the logarithm to base 10 of the cell-targeting molecule concentration administered to the respective cells (in ng/mL).

DETAILED DESCRIPTION

The present invention is described more fully hereinafter using illustrative, non-limiting embodiments, and references to the accompanying figures. This invention may, however, be embodied in many different forms and should not be construed as to be limited to the embodiments set forth below. Rather, these embodiments are provided so that this disclosure is thorough and conveys the scope of the invention to those skilled in the art.

In order that the present invention may be more readily understood, certain terms are defined below. Additional definitions may be found within the detailed description of the invention.

As used in the specification and the appended claims, the terms "a," "an" and "the" include both singular and the plural referents unless the context clearly dictates otherwise.

As used in the specification and the appended claims, the term "and/or" when referring to two species, A and B, means at least one of A and B. As used in the specification and the appended claims, the term "and/or" when referring to greater than two species, such as A, B, and C, means at least one of A, B, or C, or at least one of any combination of A, B, or C (with each species in singular or multiple possibility).

Throughout this specification, the word "comprise" or variations such as "comprises" or "comprising" will be understood to imply the inclusion of a stated integer (or components) or group of integers (or components), but not the exclusion of any other integer (or components) or group of integers (or components).

Throughout this specification, the term "including" is used to mean "including but not limited to." "Including" and "including but not limited to" are used interchangeably.

The term "amino acid residue" or "amino acid" includes reference to an amino acid that is incorporated into a protein, polypeptide, or peptide. The term "polypeptide" includes any polymer of amino acids or amino acid residues. The term "polypeptide sequence" refers to a series of amino acids or amino acid residues from which a polypeptide is physically composed. A "protein" is a macromolecule comprising one or more polypeptides or polypeptide "chains." A "peptide" is a small polypeptide of sizes less than about 15 to 20 amino acid residues. The term "amino acid sequence" refers to a series of amino acids or amino acid residues which physically comprise a peptide or polypeptide depending on the length. Unless otherwise indicated, polypeptide and protein sequences disclosed herein are written from left to right representing their order from an amino terminus to a carboxy terminus.

For purposes of the claimed invention and with regard to a Shiga toxin protein sequence or Shiga toxin derived polypeptide, the term "wild-type" generally refers to a naturally occurring, Shiga toxin protein sequence(s) found in a living species, such as, e.g., a pathogenic bacterium, wherein that Shiga toxin protein sequence(s) is one of the most frequently occurring variants. This is in contrast to infrequently occurring Shiga toxin protein sequences that, while still naturally occurring, are found in less than one percent of individual organisms of a given species out of individual organisms of that same species when sampling a statistically powerful number of naturally occurring individual organisms of that species which comprise at least one Shiga toxin protein variant. A clonal expansion of a natural isolate outside its natural environment (regardless of whether the isolate is an organism or molecule comprising biological sequence information) does not alter the naturally occurring requirement as long as the clonal expansion does not introduce new sequence variety not present in naturally occurring populations of that species and/or does not change the relative proportions of sequence variants to each other.

The terms "amino acid," "amino acid residue," "amino acid sequence," or polypeptide sequence include naturally occurring amino acids (including L and D isosteriomers) and, unless otherwise limited, also include known analogs of the twenty common natural amino acids that can function in a similar manner, such as, e.g., selenocysteine, pyrrolysine, N-formylmethionine, gamma-carboxyglutamate, hydroxyprolinehypusine, pyroglutamic acid, and selenomethionine (see e.g. Nagata K et al., *Bioinformatics* 30: 1681-9 (2014)). The amino acids referred to herein are described by shorthand designations as follows in Table A:

TABLE A

Amino Acid Nomenclature

| Name | 3-letter | 1-letter |
|---|---|---|
| Alanine | Ala | A |
| Arginine | Arg | R |
| Asparagine | Asn | N |
| Aspartic Acid or Aspartate | Asp | D |
| Cysteine | Cys | C |
| Glutamic Acid or Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Pyrroline-carboxy-lysine | Pcl | |
| Selenocysteine | Sec | |
| Serine | Ser | S |
| Threonine | Thr | T |
| Tryptophan | Trp | W |
| Tyrosine | Tyr | Y |
| Valine | Val | V |

The phrase "conservative substitution" with regard to a protein, polypeptide, or polypeptide region refers to a change in the amino acid composition of the polypeptide that does not substantially alter the function and structure of the overall protein, polypeptide, or polypeptide region (see Creighton, *Proteins: Structures and Molecular Properties* (W. H. Freeman and Company, New York (2nd ed., 1992)).

As used herein, the terms "expressed," "expressing," or "expresses," and grammatical variants thereof, refer to translation of a polynucleotide or nucleic acid into a protein. The expressed protein may remain intracellular, become a component of the cell surface membrane or be secreted into an extracellular space.

As used herein, the phrase "target-expressing cell" encompasses any cell that expresses, at a cellular surface, a target biomolecule bound by a binding region of the cell-targeting molecule of the present invention.

As used herein, cells which express a significant amount of an extracellular target biomolecule at least one cellular surface are "target positive cells" or "target+ cells" and are cells physically coupled to the specified, extracellular target biomolecule.

As used herein, cells which express a significant amount of target biomolecule at least one cellular surface are "target-positive cells" or "target+ cells" and are cells physically coupled to the extracellular target biomolecule. A significant amount of target biomolecule is defined below.

As used herein, the symbol "α" is shorthand for an immunoglobulin-type binding region capable of binding to the biomolecule following the symbol. The symbol "α" is used to refer to the functional characteristic of an immunoglobulin-type binding region based on its ability to bind to the biomolecule following the symbol with a binding affinity described by a dissociation constant ($K_D$) of $10^{-5}$ or less.

The terms "associated," "associating," "linked," or "linking" with regard to the claimed invention refers to the state of two or more components of a molecule being joined, attached, connected, or otherwise coupled to form a single molecule or the act of making two molecules associated with each other to form a single molecule by creating an association, linkage, attachment, and/or any other connection between the two molecules. For example, the term "linked"

may refer to two or more components associated by one or more atomic interactions such that a single molecule is formed and wherein the atomic interactions may be covalent and/or non-covalent. Non-limiting examples of covalent associations between two components include peptide bonds and cysteine-cysteine disulfide bonds. Non-limiting examples of non-covalent associations between two molecular components include ionic bonds.

For purposes of the present invention, the term "linked" refer to two or more molecular components associated by one or more atomic interactions such that a single molecule is formed and wherein the atomic interactions includes at least one covalent bond. For purposes of the present invention, the term "linking" refers to the act of creating a linked molecule as described above.

For purposes of the present invention, the term "fused" refers to two or more proteinaceous components associated by at least one covalent bond which is a peptide bond, regardless of whether the peptide bond involves the participation of a carbon atom of a carboxyl acid group or involves another carbon atom, such as, e.g., the α-carbon, β-carbon, γ-carbon, σ-carbon, etc. Non-limiting examples of two proteinaceous components fused together include, e.g., an amino acid, peptide, or polypeptide fused to a polypeptide via a peptide bond such that the resulting molecule is a single, continuous polypeptide. For purposes of the present invention, the term "fusing" refers to the act of creating a fused molecule as described above, such as, e.g., a fusion protein generated from the recombinant fusion of genetic regions which when translated produces a single proteinaceous molecule.

The symbol "::" means the proteinaceous molecules before and after the symbol are physically linked together to form a continuous polypeptide.

The symbol "_" with regard to a cell-targeting molecule means the molecules before and after the symbol are covalently linked together, either directly or indirectly.

For purposes of the present invention, the term "effector" means providing a biological activity, such as cytotoxicity, biological signaling, enzymatic catalysis, subcellular routing, and/or intermolecular binding resulting in the recruitment of one or more factors and/or allosteric effect(s). For example, a Shiga toxin effector polypeptide provides one or more biological activities present in a Shiga toxin, Shiga toxin component, and/or fragment thereof.

As used herein, the phrase "multivalent target-binding molecule" refers to a target-binding molecule or plurality of target-binding molecules comprising two or more high-affinity binding regions, such as, e.g. a protein comprising two or more binding regions wherein each individual binding region has a dissociation constant of $10^{-5}$ to $10^{-12}$ moles per liter toward an extracellular part of a target biomolecule.

For purposes of the present invention, the phrase "derived from" when referring to a polypeptide or polypeptide region means that the polypeptide or polypeptide region comprises amino acid sequences originally found in a "parental" protein and which may now comprise certain amino acid residue additions, deletions, truncations, rearrangements, or other alterations relative to the original polypeptide or polypeptide region as long as a certain function(s) and a structure(s) of the "parental" molecule are substantially conserved. The skilled worker will be able to identify a parental molecule from which a polypeptide or polypeptide region was derived using techniques known in the art, e.g., protein sequence alignment software.

For purposes of the present invention, a Shiga toxin effector function is a biological activity conferred by a polypeptide region derived from a Shiga toxin A Subunit. Non-limiting examples of Shiga toxin effector functions include cellular internalization, subcellular routing, catalytic activity, and cytotoxicity. Shiga toxin catalytic activities include, for example, ribosome inactivation, protein synthesis inhibition, N-glycosidase activity, polynucleotide:adenosine glycosidase activity, RNAase activity, and DNAase activity. Shiga toxins are ribosome inactivating proteins (RIPs). RIPs can depurinate nucleic acids, polynucleosides, polynucleotides, rRNA, ssDNA, dsDNA, mRNA (and polyA), and viral nucleic acids (see e.g. Brigotti M et al., *Toxicon* 39: 341-8 (2001); Brigotti M et al., *FASEB J* 16: 365-72 (2002)). Some RIPs show antiviral activity and superoxide dismutase activity. Shiga toxin catalytic activities have been observed both in vitro and in vivo. Non-limiting examples of assays for Shiga toxin effector activity measure protein synthesis inhibitory activity, depurination activity, inhibition of cell growth, cytotoxicity, supercoiled DNA relaxation activity, and nuclease activity.

As used herein, the retention of Shiga toxin effector function refers to being capable of exhibiting a level of Shiga toxin functional activity, as measured by an appropriate quantitative assay with reproducibility, comparable to a wild-type, Shiga toxin effector polypeptide control (e.g. a Shiga toxin A1 fragment) or cell-targeting molecule comprising a wild-type Shiga toxin effector polypeptide (e.g. a Shiga toxin A1 fragment) under the same conditions. For the Shiga toxin effector function of ribosome inactivation or ribosome inhibition, retained Shiga toxin effector function is exhibiting an $IC_{50}$ of 10,000 picomolar (pM) or less in an in vitro setting, such as, e.g., by using an assay known to the skilled worker and/or described herein. For the Shiga toxin effector function of cytotoxicity in a target positive cell-kill assay, retained Shiga toxin effector function is exhibiting a $CD_{50}$ of 1,000 nanomolar (nM) or less, depending on the cell type and its expression of the appropriate extracellular target biomolecule, as shown, e.g., by using an assay known to the skilled worker and/or described herein.

As used herein, the retention of "significant" Shiga toxin effector function refers to a level of Shiga toxin functional activity, as measured by an appropriate quantitative assay with reproducibility comparable to a wild-type Shiga toxin effector polypeptide control. For in vitro ribosome inhibition, significant Shiga toxin effector function is exhibiting an $IC_{50}$ of 300 pM or less depending on the source of the ribosomes (e.g. bacteria, archaea, or eukaryote (algae, fungi, plants, or animals)). This is significantly greater inhibition as compared to the approximate $IC_{50}$ of 100,000 pM for the catalytically inactive SLT-1A 1-251 double mutant (Y77S/E167D). For cytotoxicity in a target-positive cell kill assay in laboratory cell culture, significant Shiga toxin effector function is exhibiting a $CD_{50}$ of 100, 50, or 30 nM or less, depending on the cell line and its expression of the appropriate extracellular target biomolecule. This is significantly greater cytotoxicity to the appropriate target cell line as compared to an SLT-1A subunit alone, without a cell targeting binding region, which has a $CD_{50}$ of 100-10,000 nM, depending on the cell line.

For some samples, accurate values for either $IC_{50}$ or $CD_{50}$ might be unobtainable due to the inability to collect the required data points for an accurate curve fit. For example, theoretically, neither an $IC_{50}$ nor $CD_{50}$ can be determined if greater than 50% ribosome inhibition or cell death, respectively, does not occur in a concentration series for a given sample. Data insufficient to accurately fit a curve as described in the analysis of the data from exemplary Shiga toxin effector function assays, such as, e.g., assays described in the Examples, should not be considered as representative of actual Shiga toxin effector function.

A failure to detect activity in Shiga toxin effector function may be due to improper expression, polypeptide folding, and/or polypeptide stability rather than a lack of cell entry, subcellular routing, and/or enzymatic activity. Assays for Shiga toxin effector functions may not require much cell-targeting molecule of the invention to measure significant amounts of Shiga toxin effector function activity. To the extent that an underlying cause of low or no effector function is determined empirically to relate to protein expression or stability, one of skill in the art may be able to compensate for such factors using protein chemistry and molecular engineering techniques known in the art, such that a Shiga toxin functional effector activity may be restored and measured. As examples, improper cell-based expression may be compensated for by using different expression control sequences; improper polypeptide folding and/or stability may benefit from stabilizing terminal sequences, or compensatory mutations in non-effector regions which stabilize the three-dimensional structure of the protein, etc. When new assays for individual Shiga toxin functions become available, Shiga toxin effector regions or polypeptides may be analyzed for any level of those Shiga toxin effector functions, such as for being within a certain-fold activity of a wild-type Shiga toxin effector polypeptide. Examples of meaningful activity differences are, e.g., Shiga toxin effector regions that have 1000-fold or 100-fold or less the activity of a wild-type Shiga toxin effector polypeptide; or that have 3-fold to 30-fold or more activity compared to a functional knock-down or knockout Shiga toxin effector polypeptide.

Certain Shiga toxin effector functions are not easily measurable, e.g. subcellular routing functions. Currently there is no routine, quantitative assay to distinguish whether the failure of a Shiga toxin effector polypeptide to be cytotoxic is due to improper subcellular routing, but at a time when tests are available, Shiga toxin effector polypeptides may be analyzed for any significant level of subcellular routing as compared to the appropriate wild-type Shiga toxin effector region.

It should be noted that even if the cytotoxicity of a Shiga toxin effector polypeptide is reduced relative to wild-type, in practice, applications using attenuated, Shiga toxin effector polypeptides may be equally or more effective than those using wild-type, Shiga toxin effector polypeptides because the highest potency variants might exhibit undesirable effects which are minimized or reduced in reduced-potency variants. Wild-type Shiga toxin effector polypeptides are very potent, being able to kill with only one molecule reaching the cytosol or perhaps 40 molecules being internalized (Tam P, Lingwood C, *Microbiology* 153: 2700-10 (2007)). Shiga toxin effector polypeptides with even considerably reduced Shiga toxin effector functions, such as, e.g., subcellular routing or cytotoxicity, as compared to wild-type Shiga toxin effector polypeptides may still be potent enough for practical applications involving targeted cell killing and/or detection of certain subcellular compartments of specific cell types. And such effector polypeptides may also be useful for delivering cargos (e.g. additional exogenous material) to certain intracellular locations or subcellular compartments.

The term “selective cytotoxicity” with regard to the cytotoxic activity of a cytotoxic, cell-targeting molecule refers to the relative levels of cytotoxicity between a targeted cell population and a non-targeted bystander cell population, which can be expressed as a ratio of the half-maximal cytotoxic concentration ($CD_{50}$) for a targeted cell type over the $CD_{50}$ for an untargeted cell type to show the preferentiality of cell killing of the targeted cell type as a metric for selectivity.

As used in the specification and the claims herein, the phrase “physiological temperature appropriate for the cell” refers to temperatures known in the art and/or identifiable by the skilled worker which fall within a range suitable for healthy growth, propagation, and/or function of that particular cell or cell type; corresponding to the core temperature of the species from which the cell is derived; and/or corresponding to a healthy, living organism comprising the cell. For example, temperatures around 37° C. are appropriate for many mammalian cells depending on the species.

For purposes of the present invention, the phrase “internalization of a molecular complex comprising the cell-targeting molecule bound to target biomolecule” means the cellular internalization of the cell-targeting molecule is target-mediated in that the internalization begins with the cell-targeting molecule and cell-surface target biomolecule forming a complex at an extracellular position and ends with both the cell-targeting molecule and target biomolecule(s) entering the cell prior to dissociation of the cell-targeting molecule from the target biomolecule(s) to which the cell-targeting molecule has bound.

For purposes of the present invention, the phrase “target biomolecule natively present on the surface of a cell” means a cell expresses the target biomolecule using its own internal machinery and localizes the target biomolecule to a cellular surface using its own internal machinery such that the target biomolecule is physically coupled to said cell and at least a part of the target biomolecule is accessible from an extracellular space, i.e. on the surface of a cell.

For purposes of the present invention, the phrase “cell-targeting molecule altering agent” refers to any of a number of different types of atoms or molecules known to the skilled worker and/or described herein which may be conjugated to a molecule of the invention in order to alter one or more properties of the molecule of the invention.

For the purposes of certain embodiments of the present invention, cellular internalization is considered rapid if the time for internalization to occur due to the binding of the cell-targeting molecule of the present invention is reduced as compared to the time for internalization of a prior art reference molecule at the same percent target biomolecule occupancy as determined by the same assay using the same cell type at the same temperature.

As used in the specification and the claims herein, the phrase “rapid cellular internalization” refers to the ability of a cell-targeting molecule of the present invention to decrease the time on average for cellular internalization of an extracellular target antigen or cell surface localized target biomolecule as compared to the time on average required for cellular internalization of an extracellular target antigen or cell surface localized target biomolecule, as measured by any one of a number of cell internalization assays known in the art or described herein.

As used in the specification and the claims herein, the phrase “rapid internalization” includes internalization which may be assayed as compared to a basal target biomolecule internalization rate and/or molecular binding induced internalization rate for target biomolecule after administration of an immunoglobulin-type binding molecule (e.g. a monoclonal antibody) known in the art to bind an extracellular part of target biomolecule. The scope of the phrase “rapid cellular internalization” is intended to encompass internalization rates, on average, faster than those observed when testing a target-specific antibody or immunoglobulin-derived protein molecule with an Fc region. In general, an internalization rate constant may be defined as the time after administration of a target-specific binding molecule of interest to target-positive cells at which 50% of cell surface target antigens, target biomolecules, and/or the target-specific binding molecule is internalized at a given administered concentration, mass, molarity, or target biomolecule occupancy-adjusted concentration, to a particular cell type, and at a particular temperature. Cell-surface target biomolecule internalization, whether basally or in response to administration of a target-binding molecule, may be assayed by various methods known to the skilled worker.

For the purposes of certain embodiments of the present invention, cellular internalization is considered rapid if the time for internalization to occur due to the binding of the cell-targeting molecule of the present invention is reduced as compared to the time for internalization of the target biomolecule with the binding of a well-characterized antibody recognizing an extracellular target biomolecule antigen. The term "rapid" as used throughout the present description is intended to indicate that a cell-targeting molecule of the present invention enters one or more target-expressing and/or target-positive cells in less than six hours. In certain embodiments, rapid can be as quickly as less than about thirty minutes, but can also encompass a range of from about 1 hour to about 2 hours, to about 3 hours, to about 4 hours, to about 5 hours; a range of about 2 hours to about 3 hours, to about 4 hours, to about 5 hours; a range of about 3 hours to about 4 hours, to about 5 hours; and a range of about 4 hours to about 5 hours.

For purposes of the present invention, the phrase "one or more non-covalent linkages," with regard to a molecule comprising two or more components linked together, includes the types of linkages connecting the components that in certain molecules may be observed as being eliminated (i.e., no longer connecting two or more components) when changing the molecule from native protein-folding conditions to protein-denaturing conditions. For example, when using techniques known in the art and/or described herein, such as, e.g., electrophoretic and/or chromatographic assays, for assaying the sizes of proteinaceous molecules, a multi-component molecule that appears as a single-sized species under native protein-folding conditions (e.g. pH-buffered environments intended to be similar to the lumen of the endoplasmic reticulum of a eukaryotic cell or to an extracellular environment within an organism), can also be observed as being composed of two or more smaller-sized, proteinaceous molecules under denaturing conditions and/or after being subjected to a denaturing condition. "Protein-denaturing" conditions are known to the skilled worker and include conditions markedly different from native protein-folding conditions, such as, e.g., environments with a high temperature (e.g., greater than 50 degrees Celsius) and/or those characterized by the presence of chemical denaturants and/or detergents, such as, e.g., 1-10% sodium dodecyl sulfate, polysorbates, Triton® X-100, sarkosyl, and other detergents whether ionic, non-ionic, zwitterionic, and/or chaotropic.

As used herein, the term "monomeric" with regard to describing a protein and/or proteinaceous molecule refers to a molecule comprising only one polypeptide component consisting of a single, continuous polypeptide, regardless of its secondary or tertiary structure, which may be synthesized by a ribosome from a single polynucleotide template, including a continuous linear polypeptide which later forms a cyclic structure. In contrast, a multimeric molecule comprises two or more polypeptides (e.g. subunits) which together do not form a single, continuous polypeptide that may be synthesized by a ribosome from a single polynucleotide template.

As used herein, the term "multimeric" with regard to describing a protein and/or proteinaceous molecule refers to a molecule that comprises two or more, individual, polypeptide components associated together and/or linked together, such as, e.g., a molecule consisting of two components each of which is its own continuous polypeptide. For example, the association or linkage between components of a molecule may include 1) one or more non-covalent interactions; 2) one or more post-translational, covalent interactions; 3) one or more, covalent chemical conjugations; and/or 4) one or more covalent interactions resulting in a single molecule comprising a non-linear polypeptide, such as, e.g., a branched or cyclic polypeptide structure, resulting from the arrangement of the two or more polypeptide components. A molecule comprising two, discontinuous polypeptides as a result of the proteolytic cleavage of one or more peptide bonds in a single, continuous polypeptide synthesized by a ribosome from a single polynucleotide templates is "multimeric" and not "monomeric."

As used herein, the terms "disrupted," "disruption," or "disrupting," and grammatical variants thereof, with regard to a polypeptide region or feature within a polypeptide refers to an alteration of at least one amino acid within the region or composing the disrupted feature.

Amino acid alterations include various mutations, such as, e.g., a deletion, inversion, insertion, or substitution which alter the amino acid sequence of the polypeptide. Amino acid alterations also include chemical changes, such as, e.g., the alteration one or more atoms in an amino acid functional group or the addition of one or more atoms to an amino acid functional group.

As used herein, "de-immunized" means reduced antigenic and/or immunogenic potential after administration to a chordate as compared to a reference molecule, such as, e.g., a wild-type peptide region, polypeptide region, or polypeptide. This includes a reduction in overall antigenic and/or immunogenic potential despite the introduction of one or more, de novo, antigenic and/or immunogenic epitopes as compared to a reference molecule. For certain embodiments, "de-immunized" means a molecule exhibited reduced antigenicity and/or immunogenicity after administration to a mammal as compared to a "parental" molecule from which it was derived, such as, e.g., a wild-type Shiga toxin A1 fragment. In certain embodiments, the de-immunized, Shiga toxin effector polypeptide of the present invention is capable of exhibiting a relative antigenicity compared to a reference molecule which is reduced by 10%, 20%, 30%, 40%, 50%, 60%, 70%, 80%, 90%, or greater than the antigenicity of the reference molecule under the same conditions measured by the same assay, such as, e.g., an assay known to the skilled worker and/or described herein like a quantitative ELISA or Western blot analysis. In certain embodiments, the de-immunized, Shiga toxin effector polypeptide of the present invention is capable of exhibiting a relative immunogenicity compared to a reference molecule which is reduced by 10%, 20%, 30%, 40%, 50%, 60%, 70%, 80%, 90%, 95%, 97%, 99%, or greater than the immunogenicity of the reference molecule under the same conditions measured by the same assay, such as, e.g., an assay known to the skilled worker and/or described herein like a quantitative measurement of anti-molecule antibodies produced in a mammal(s) after receiving parenteral administration of the molecule at a given time-point. The relative immunogenicities of exemplary cell-targeting molecules may be determined using an assay for in vivo antibody responses to the cell-targeting molecules after repeat, parenteral administrations over periods of many.

For purposes of the present invention, the terms "terminus," "amino-terminus," or "carboxy-terminus" with regard to a cell-targeting molecule refers generally to the last amino acid residue of a polypeptide chain of the cell-targeting molecule (e.g., a single, continuous polypeptide chain). A cell-targeting molecule may comprise more than one polypeptides or proteins, and, thus, a cell-targeting molecule of the present invention may comprise multiple amino-terminals and carboxy-terminals. For example, the "amino-terminus" of a cell-targeting molecule may be defined by the first amino acid residue of a polypeptide chain representing the amino-terminal end of the polypeptide, which is generally characterized by a starting, amino acid residue which does not have a peptide bond with any amino acid residue involving the primary amino group of the starting amino acid residue or involving the equivalent nitrogen for starting amino acid residues which are members of the class of N-alkylated alpha amino acid residues. Similarly, the "carboxy-terminus" of a cell-targeting molecule may be defined by the last amino acid residue of a polypeptide chain representing the carboxyl-terminal end of the polypeptide, which is generally characterized by a final, amino acid residue which does not have any amino acid residue linked by a peptide bond to the alpha-carbon of its primary carboxyl group.

For purposes of the present invention, the terms "terminus," "amino-terminus," or "carboxy-terminus" with regard to a polypeptide region refers to the regional boundaries of that region, regardless of whether additional amino acid residues are linked by peptide bonds outside of that region. In other words, the terminals of the polypeptide region regardless of whether that region is fused to other peptides or polypeptides. For example, a fusion protein comprising two proteinaceous regions, e.g., a binding region comprising a peptide or polypeptide and a Shiga toxin effector polypeptide, may have a Shiga toxin effector polypeptide region with a carboxy-terminus ending at amino acid residue 251 of the Shiga toxin effector polypeptide region despite a peptide bond involving residue 251 to an amino acid residue at position 252 representing the beginning of another proteinaceous region, e.g., the binding region. In this example, the carboxy-terminus of the Shiga toxin effector polypeptide region refers to residue 251, which is not a terminus of the fusion protein but rather represents an internal, regional boundary. Thus, for polypeptide regions, the terms "terminus," "amino-terminus," and "carboxy-terminus" are used to refer to the boundaries of polypeptide regions, whether the boundary is a physically terminus or an internal, position embedded within a larger polypeptide chain.

For purposes of the present invention, the phrase "furin-cleavage resistant" means a molecule or specific polypeptide region thereof exhibits reproducibly less furin cleavage than (i) the carboxy-terminus of a Shiga toxin A1 fragment in a wild-type Shiga toxin A Subunit or (ii) the carboxy-terminus of the Shiga toxin A1 fragment derived region of construct wherein the naturally occurring furin-cleavage site natively positioned at the junction between the A1 and A2 fragments is not disrupted; as assayed by any available means to the skilled worker, including by using a method described herein.

For purposes of the present invention, the phrase "disrupted furin-cleavage motif" refers to (i) a specific furin-cleavage motif as described herein in Section I-B and (ii) which comprises a mutation and/or truncation that can confer a molecule with a reduction in furin-cleavage as compared to a reference molecule, such as, e.g., a reduction in furin-cleavage reproducibly observed to be 30%, 40%, 50%, 60%, 70%, 80%, 90%, 95%, 97%, 98%, 99%, or less (including 100% for no cleavage) than the furin-cleavage of a reference molecule observed in the same assay under the same conditions. The percentage of furin-cleavage as compared to a reference molecule can be expressed as a ratio of cleaved:uncleaved material of the molecule of interest divided by the cleaved:uncleaved material of the reference molecule (see e.g. WO 2015/191764). Non-limiting examples of suitable reference molecules include certain molecules comprising a wild-type Shiga toxin furin-cleavage motif and/or furin-cleavage site are described in WO 2015/191764 and WO 2016/196344.

Introduction

The present invention provides Shiga toxin effector polypeptides and cell-targeting molecules comprising specific attachment sites for conjugating other molecules. A unique amino acid residue with a unique functional group that is solvent accessible and/or one or more position-ectopic residues in a Shiga toxin effector polypeptide or cell-targeting molecule scaffold provides an attachment point for the site-specific linking of various atoms and molecules. The atoms or molecules may function as (1) cargos designed for intracellular delivery, including for controlled liberation once inside a target cell, and/or (2) agents having extracellular function(s), such as, e.g., biologically inert moieties which prolong half-life in a vertebrate, mask immunogenic portions of the scaffold, and/or block proteolytic cleavage. The Shiga toxin effector polypeptides and cell-targeting molecules of the present invention may be conjugated to a variety of atoms and molecules in a controlled and convenient manner using routine methods in order to obtain homogenous products.

The present invention also provides Shiga toxin effector polypeptides and cell-targeting molecules conjugated to other molecules, such as, e.g., a molecular cargo for intracellular delivery or a cell-targeting molecule altering agent. Certain cell-targeting molecules of the present invention, and compositions thereof, may be used to selectively deliver conjugated cargo(s) to a target-expressing cell type(s) in the presence of one or more other cell types based on its cell-targeting and cellular internalization activity(ies), such as, e.g., a cargo having a desired, intracellular function. In addition, certain cell-targeting molecules of the present invention, and compositions thereof, may be used to selectively kill a target-expressing cell in the presence of one or more other cell types based on its cell-targeting activity and cellular internalization activity(ies), such as, e.g., by delivering into the interior of the targeted, target-expressing cell a component of the cell-targeting molecule which is cytotoxic at an intracellular location. The conjugated atoms, molecules, cargos, and/or cell-targeting molecule altering agents contemplated as suitable for use in the present invention include linkers, cell-targeting moieties, antibiotics, peptides, nucleic acids, proteins, protein-nucleic acid complexes, cytotoxic agents, solubility-altering agents, pharmacokinetic-altering agents, immunogenicity-altering agents, and pharmacodynamics-altering agents.

The molecules of the present invention, and compositions thereof, have uses, e.g., for the selective delivery of cargos to target-expressing cells and as therapeutics for the treatment of a variety of diseases, disorders, and conditions.

I. General Structures of the Shiga Toxin Effector Polypeptides and Cell-Targeting Molecules of the Present Invention Certain embodiments of the present invention are Shiga toxin A Subunit effector polypeptides, such as, e.g., (1) a Shiga toxin effector polypeptide conjugated to a heterologous molecule; and (2) a Shiga toxin effector polypeptide comprising one or more ectopic amino acid residues relative to wild-type, Shiga toxin polypeptides. The present invention provides cell-targeting molecules comprising (1) a cell-targeting moiety (e.g. a cell-targeting agent and/or binding region) and (2) a toxin effector polypeptide region. Certain further embodiments are cell-targeting molecules comprising a Shiga toxin effector polypeptide of the present invention. In addition, the present invention provides cell-targeting molecules lacking any Shiga toxin effector polypeptide but comprising a linker or binding region (e.g. an immunoglobulin-type polypeptide) comprising functional group(s) for site specific attachment of other molecules. All of the molecules of the present invention may be optionally conjugated to another molecule, such as, e.g., a cargo for cell-targeted delivery, a cell-targeting molecule altering agent, and/or an additional exogenous material.

A. Shiga Toxin Effector A Subunit Polypeptides of the Present Invention

A Shiga toxin effector polypeptide of the present invention is a polypeptide derived from a Shiga toxin A Subunit of at least one member of the Shiga toxin family wherein the Shiga toxin effector region is capable of exhibiting at least one Shiga toxin function. Shiga toxin functions include, e.g., promoting cell entry, deforming lipid membranes, stimulating clathrin-mediated endocytosis, directing retrograde transport, directing subcellular routing, avoiding intracellular degradation, catalytically inactivating ribosomes, effectuating cytotoxicity, and effectuating cytostatic effects.

There are numerous Shiga toxin effector polypeptides known to the skilled worker (see e.g., Cheung M et al., *Mol Cancer* 9: 28 (2010); WO 2014/164693; WO 2015/113005; WO 2015/113007; US20150259428; WO 2015/191764; US20160177284; WO 2016/126950) that are suitable for use in the present invention or to use as parental polypeptides to be modified into a Shiga toxin effector polypeptide of the present invention using techniques known the art.

Shiga toxin effector polypeptides of the present invention comprise or consist essentially of a polypeptide derived from a Shiga toxin A Subunit dissociated from any form of its native Shiga toxin B Subunit. In addition, the cell-targeting molecules of the present invention need not comprise any polypeptide comprising or consisting essentially of a functional binding domain of a native Shiga toxin B subunit. Rather, the Shiga toxin effector polypeptides of the present invention may be functionally associated with heterologous binding regions to effectuate cell targeting.

In certain embodiments, a Shiga toxin effector polypeptide of the present invention may comprise or consist essentially of a full-length Shiga toxin A Subunit (e.g. SLT-1A (SEQ ID NO:1), StxA (SEQ ID NO:2), or SLT-2A (SEQ ID NO:3)), noting that naturally occurring Shiga toxin A Subunits may comprise precursor forms containing signal sequences of about 22 amino acids at their amino-terminals which are removed to produce mature Shiga toxin A Subunits and are recognizable to the skilled worker. In other embodiments, the Shiga toxin effector polypeptide of the invention comprises or consists essentially of a truncated Shiga toxin A Subunit which is shorter than a full-length Shiga toxin A Subunit, such as, e.g., a truncation known in the art (see e.g., WO 2014/164693; WO 2015/113005; WO 2015/113007; WO 2015/138452; WO 2015/191764; US20160177284; WO 2016/126950).

Although derived from a wild-type Shiga toxin A Subunit polypeptide, for certain embodiments of the molecules of the present invention, the Shiga toxin effector polypeptide differs from a naturally occurring Shiga toxin A Subunit by up to 1, 2, 3, 4, 5, 6, 7, 8, 9, 10, 15, 20, 25, 30, 35, 40 or more amino acid residues (but by no more than that which retains at least 85%, 90%, 95%, 99%, or more amino acid sequence identity).

In certain embodiments, the Shiga toxin effector polypeptide of the present invention comprises only one lysine residue. The cytotoxic activity of the SLT-1 holotoxin was not affected by the removal of all lysine residues from the A Subunit (McCluskey, A J, "Shiga-like Toxin 1: Molecular Mechanism of Toxicity and Discovery of Inhibitors", thesis, University of Toronto, (2012), Appendix B). Moreover, the removal of both amino-terminal lysines of the A Subunit of SLT-1 did not affect its cytotoxicity (McCluskey, A J, "Shiga-like Toxin 1: Molecular Mechanism of Toxicity and Discovery of Inhibitors", thesis, University of Toronto, (2012), Appendix B). Thus, all but one of the naturally occurring lysine residues in SLT-1A, StxA, and/or SLT-2A may be removed by amino acid residue substitution thereby leaving only one natively occurring lysine residue in a Shiga toxin effector polypeptide. Alternatively, all of the naturally occurring lysine residues in SLT-1A, StxA, and/or SLT-2A may be removed from a Shiga toxin effector polypeptide by amino acid residue substitution and an ectopic lysine residue may be engineered into a suitable position for site-specific conjugation and retention of one or more Shiga toxin functions.

B. Cell-Targeting Molecules of the Present Invention

The cell-targeting molecules of the present invention all comprise a cell-targeting agent or moiety, such as, e.g., a binding region described herein. Cell-targeting agents or moieties of the cell-targeting molecules of the present invention comprise molecular structures, that when linked to a polypeptide of the present invention, are each capable of bringing the cell-targeting molecule within close proximity to specific cells based on molecular interactions on the surfaces of those specific cells. Cell-targeting moieties include ligand and polypeptides which bind to cell-surface targets.

One type of cell-targeting moiety is a proteinaceous binding region. Binding regions of the cell-targeted molecules of the present invention comprise one or more polypeptides capable of selectively and specifically binding an extracellular target biomolecule. Binding regions may comprise one or more various polypeptide moieties, such as ligands whether synthetic or naturally occurring ligands and derivatives thereof, immunoglobulin derived domains, synthetically engineered scaffolds as alternatives to immunoglobulin domains, and the like. The use of proteinaceous binding regions in cell-targeting molecules of the invention allows for the creation of cell-targeting molecules which are single-chain, cell-targeting proteins.

Certain embodiments of the cell-targeting molecules of the present invention comprise a cell-targeting binding region capable of specifically binding to an extracellular part of a target biomolecule physically coupled to a cell. The binding region of a cell-targeting molecule of the present invention comprises a peptide or polypeptide region capable of binding specifically to a target biomolecule. In certain embodiments, the binding region of a cell-targeting molecule of the invention comprises one or more polypeptides capable of selectively and specifically binding an extracellular target biomolecule. Binding region may comprise one or more various peptidic or polypeptide moieties, such as randomly generated peptide sequences, naturally occurring ligands or derivatives thereof, immunoglobulin derived domains, synthetically engineered scaffolds as alternatives to immunoglobulin domains, and the like.

There are numerous binding regions known in the art that are useful for targeting polypeptides to specific cell-types via their binding characteristics, such as ligands, monoclonal antibodies, engineered antibody derivatives, and engineered alternatives to antibodies (see e.g., Cheung M et al., *Mol Cancer* 9: 28 (2010); WO 2014/164680; WO 2014/164693; WO 2015/113005; WO 2015/113007; WO 2015/138435; WO 2015/138452; US20150259428; WO 2015/191764; US20160177284; WO 2016/126950).

According to one specific, but non-limiting aspect, the binding region of the molecule of the invention comprises a naturally occurring ligand or derivative thereof that retains binding functionality to an extracellular target biomolecule, commonly a cell surface receptor. For example, various cytokines, growth factors, and hormones known in the art may be used to target the cell-targeting molecule to the cell-surface of specific cell types expressing a cognate cytokine receptor, growth factor receptor, or hormone receptor.

According to certain other embodiments, the binding region comprises a synthetic ligand capable of binding an extracellular target biomolecule.

According to one specific, but non-limiting aspect, the binding region may comprise an immunoglobulin-type binding region. The term "immunoglobulin-type binding region" as used herein refers to a polypeptide region capable of binding one or more target biomolecules, such as an antigen or epitope. Binding regions may be functionally defined by their ability to bind to target molecules. Immunoglobulin-type binding regions are commonly derived from antibody or antibody-like structures; however, alternative scaffolds from other sources are contemplated within the scope of the term.

Immunoglobulin (Ig) proteins have a structural domain known as an Ig domain. Ig domains range in length from about 70-110 amino acid residues and possess a characteristic Ig-fold, in which typically 7 to 9 antiparallel beta strands arrange into two beta sheets which form a sandwich-like structure. The Ig fold is stabilized by hydrophobic amino acid interactions on inner surfaces of the sandwich and highly conserved disulfide bonds between cysteine residues in the strands. Ig domains may be variable (IgV or V-set), constant (IgC or C-set) or intermediate (IgI or I-set). Some Ig domains may be associated with a complementarity determining region or complementary determining region (CDR) which is important for the specificity of antibodies binding to their epitopes. Ig-like domains are also found in non-immunoglobulin proteins and are classified on that basis as members of the Ig superfamily of proteins. The HUGO Gene Nomenclature Committee (HGNC) provides a list of members of the Ig-like domain containing family.

As used herein, the term "heavy chain variable ($V_H$) domain" or "light chain variable ($V_L$) domain" respectively refer to any antibody $V_H$ or $V_L$ domain (e.g. a human $V_H$ or $V_L$ domain) as well as any derivative thereof retaining at least qualitative antigen binding ability of the corresponding native antibody (e.g. a humanized $V_H$ or $V_L$ domain derived from a native murine $V_H$ or $V_L$ domain). A $V_H$ or $V_L$ domain consists of a "framework" region interrupted by the three CDRs or ABRs. The framework regions serve to align the CDRs for specific binding to an epitope of an antigen. From amino-terminus to carboxyl-terminus, both $V_H$ and $V_L$ domains comprise the following framework (FR) and CDR regions: FR1, CDR1, FR2, CDR2, FR3, CDR3, and FR4. For camelid $V_HH$ fragments, IgNARs of cartilaginous fish, $V_{NAR}$ fragments, and derivatives thereof, there is a single heavy chain variable domain comprising the same basic arrangement: FR1, CDR1, FR2, CDR2, FR3, CDR3, and FR4.

An immunoglobulin-type binding region may be a polypeptide sequence of an antibody or antigen-binding fragment thereof wherein the amino acid sequence has been varied from that of a native antibody or an Ig-like domain of a non-immunoglobulin protein, for example by molecular engineering or selection by library screening. Because of the relevance of recombinant DNA techniques and in vitro library screening in the generation of immunoglobulin-type binding regions, antibodies can be redesigned to obtain desired characteristics, such as smaller size, cell entry, or other therapeutic improvements. The possible variations are many and may range from the changing of just one amino acid to the complete redesign of, for example, a variable region. Typically, changes in the variable region will be made in order to improve the antigen-binding characteristics, improve variable region stability, or reduce the potential for immunogenic responses.

There are numerous immunoglobulin-type binding regions contemplated as components of the molecules of the present invention, such as, e.g., the cell-targeting molecules of the present invention. An immunoglobulin binding region generally comprises one or more CDRs. In certain embodiments, the immunoglobulin-type binding region is derived from an immunoglobulin binding region, such as an antibody paratope capable of binding an extracellular target biomolecule. In certain other embodiments, the immunoglobulin-type binding region comprises an engineered polypeptide not derived from any immunoglobulin domain but which functions like an immunoglobulin binding region by providing high-affinity binding to an extracellular target biomolecule. This engineered polypeptide may optionally include polypeptide scaffolds comprising or consisting essentially of complementary determining regions from immunoglobulins as described herein.

There are also numerous binding regions in the prior art that are useful for targeting polypeptides to specific cell-types via their high-affinity binding characteristics. In certain embodiments, the binding region of the present proteins is selected from the group which includes single-domain antibody domains (sdAbs), nanobodies, heavy-chain antibody domains derived from camelids ($V_HH$ fragments), bivalent nanobodies, heavy-chain antibody domains derived from cartilaginous fishes, immunoglobulin new antigen receptors (IgNARs), $V_{NAR}$ fragments, single-chain variable (scFv) fragments, autonomous $V_H$ domains, single-domain antibody domains (sdAbs), heavy-chain antibody domains derived from camelids ($V_HH$ fragments or $V_H$ domain fragments), heavy-chain antibody domains derived from camelid $V_HH$ fragments or $V_H$ domain fragments, heavy-chain antibody domains derived from cartilaginous fishes, immunoglobulin new antigen receptors (IgNARs), $V_{NAR}$ fragments, single-chain variable (scFv) fragments, nanobodies, Fd fragments consisting of the heavy chain and $C_H1$ domains, single chain Fv-$C_H3$ minibodies, dimeric $C_H2$ domain fragments ($C_H2D$), Fc antigen binding domains (Fcabs), isolated complementary determining region 3 (CDR3) fragments, constrained framework region 3, CDR3, framework region 4 (FR3-CDR3-FR4) polypeptides, small modular immunopharmaceutical (SMIP) domains, multimerizing $V_HH$ fragments, scFv-Fc fusions, multimerizing scFv fragments (diabodies, triabodies, tetrabodies), disulfide stabilized antibody variable (Fv) fragments, disulfide stabilized antigen-binding (Fab) fragments consisting of the $V_L$, $V_H$, CL and $C_H1$ domains, bivalent nanobodies, bivalent minibodies, bivalent F(ab')2 fragments (Fab dimers), bispecific tandem $V_HH$ fragments, bispecific tandem scFv fragments, bispecific nanobodies, bispecific minibodies, and any genetically manipulated counterparts of the foregoing that retain its paratope and binding function (see e.g. Ward E et al., *Nature* 341: 544-6 (1989); *Davies J, Riechmann L, Biotechnology* (NY) 13: 475-9 (1995); Reiter Y et al., *Mol Biol* 290: 685-98 (1999); Riechmann L, Muyldermans S, *J Immunol Methods* 231: 25-38 (1999); Tanha J et al., *J Immunol Methods* 263: 97-109 (2002); Vranken W et al., *Biochemistry* 41: 8570-9 (2002); Dottorini T et al., *Biochemistry* 43: 622-8 (2004); Jespers L et al., *J Mol Biol* 337: 893-903 (2004); Jespers L et al., *Nat Biotechnol* 22: 1161-5 (2004); To R et al., *J Biol Chem* 280: 41395-403 (2005); Spinelli S et al., *FEBS Lett* 564: 35-40 (2004); Saerens D et al., *Curr Opin Pharmacol* 8: 600-8 (2008); Dimitrov D, *MAbs* 1: 26-8 (2009); Baral T et al., *PLoS One* 7: e30149 (2012); Ahmad Z et al., *Clin Dev Immunol* 2012: 980250 (2012); Weiner L, *Cell* 148: 1081-4 (2012); Richard G et al., *PLoS One* 8: e69495 (2013)). There are a variety of binding regions comprising polypeptides derived from the constant regions of immunoglobulins, such as, e.g., engineered dimeric Fc domains, monomeric Fcs (mFcs), $V_HH$-Fc fusions, scFv-Fc fusions, $C_H2$ domains, monomeric $C_H3$s domains (mCH3s), synthetically reprogrammed immunoglobulin domains, and/or hybrid fusions of immunoglobulin domains with ligands (Hofer T et al., *Proc Natl Acad Sci USA* 105: 12451-6 (2008); Xiao J et al., *J Am Chem Soc* 131: 13616-13618 (2009); Xiao X et al., *Biochem Biophys Res Commun* 387: 387-92 (2009); Wozniak-Knopp G et al., *Protein Eng Des Sel* 23 289-97 (2010); Gong R et al., *PLoS ONE* 7: e42288 (2012); Wozniak-Knopp G et al., *PLoS ONE* 7: e30083 (2012); Ying T et al., *J Biol Chem* 287: 19399-408 (2012); Ying T et al., *J Biol Chem* 288: 25154-64 (2013); Chiang Metal., *J Am Chem Soc* 136: 3370-3 (2014); Rader C, *Trends Biotechnol* 32: 186-97 (2014); Ying T et al., *Biochimica Biophys Acta* 1844: 1977-82 (2014).

In accordance with certain other embodiments, the binding region includes engineered, alternative scaffolds to immunoglobulin domains that exhibit similar functional characteristics, such as high-affinity and specific binding of target biomolecules, and enables the engineering of improved characteristics, such as greater stability or reduced immunogenicity. For certain embodiments of the cell-targeting molecules of the present the invention, the binding region is selected from the group which includes engineered Armadillo repeat polypeptides (ArmRPs), engineered, fibronectin-derived, $10^{th}$ fibronectin type III (10Fn3) domain (monobodies, AdNectins™, or AdNexins™); engineered, tenascin-derived, tenascin type III domain (Centryns™); engineered, ankyrin repeat motif containing polypeptide (DARPins™); engineered, low-density-lipoprotein-receptor-derived, A domain (LDLR-A) (Avimers™); lipocalin (anticalins); engineered, protease inhibitor-derived, Kunitz domain; engineered, Protein-A-derived, Z domain (Affibodies™); engineered, gamma-B crystallin-derived scaffold or engineered, ubiquitin-derived scaffold (Affilins); Sac7d-derived polypeptides (Nanoffitins® or affitins); engineered, Fyn-derived, SH2 domain (Fynomers®); and engineered antibody mimic and any genetically manipulated counterparts of the foregoing that retains its binding functionality (Worn A, Plückthun A, *J Mol Biol* 305: 989-1010 (2001); Xu L et al., *Chem Biol* 9: 933-42 (2002); Wikman M et al., *Protein Eng Des Sel* 17: 455-62 (2004); Binz H et al., *Nat Biotechnol* 23: 1257-68 (2005); Holliger P, Hudson P, *Nat Biotechnol* 23: 1126-36 (2005); Gill D, Damle N, *Curr Opin Biotech* 17: 653-8 (2006); Koide A, Koide S, *Methods Mol Biol* 352: 95-109 (2007); Byla P et al., *J Biol Chem* 285: 12096 (2010); Zoller F et al., *Molecules* 16: 2467-85 (2011); Alfarano P et al., *Protein Sci* 21: 1298-314 (2012); Madhurantakam C et al., *Protein Sci* 21: 1015-28 (2012); Varadamsetty G et al., *J Mol Biol* 424: 68-87 (2012)).

Among certain embodiments of the present invention, the immunoglobulin-type binding region is derived from a nanobody or single domain immunoglobulin-derived region $V_HH$. Generally, nanobodies are constructed from fragments of naturally occurring single, monomeric variable domain antibodies (sdAbs) of the sort found in camelids and cartilaginous fishes (Chondrichthyes). Nanobodies are engineered from these naturally occurring antibodies by truncating the single, monomeric variable domain to create smaller and more stable molecules, such as, e.g., IgNAR, $V_HH$, and $V_{NAR}$ constructs. Due to their small size, nanobodies are able to bind to antigens that are not accessible to whole antibodies.

In certain embodiments of the cell-targeting molecule of the present invention, the binding region comprises a polypeptide(s) selected from the group consisting of: a) a heavy chain variable ($V_H$) domain comprising (i) a HABR1 or HCDR1, (ii) a HABR2 or HCDR2, and (iii) a HABR3 or HCDR3; and/or b) a light chain variable ($V_L$) domain comprising (i) a LABR1 or LCDR1, (ii) a LABR2 or LCDR2, and (iii) a LABR3 or LCDR3; wherein each of the aforementioned ABRs and/or CDRs is selected from the polypeptide comprising or consisting essentially of one of the amino acid sequence as shown in SEQ ID NOs: 844-1100. In certain further embodiments, the binding region comprises or consists essentially of 269-499 of any one of SEQ ID NOs: 807-808 and 812-813, comprises or consists essentially of amino acids of 269-519 of any one of SEQ ID NOs: 814-815 and 818-829, or comprises or consists essentially of amino acids 268-386 of any one of SEQ ID NOs: 816-817.

In certain embodiments of the present invention, the binding region polypeptide comprises a free cysteine residue suitable for conjugation to another molecule, wherein the cysteine is at or proximal to a carboxy-terminus of the binding region polypeptide. In certain further embodiments, the binding region of a cell-targeting molecule of the present invention comprises a series of amino acid residues represented by (X)n-C—X or (X)n-C, where X refers to any amino acid, (X)n refers to a polypeptide comprising a binding domain, and C refers to a cysteine residue.

In certain embodiments of the present invention, the binding region polypeptide comprises a free cysteine residue suitable for conjugation to another molecule, wherein the cysteine is at or proximal to an amino-terminus of the binding region polypeptide. In certain further embodiments, the binding region of a cell-targeting molecule of the present invention comprises a series of amino acid residues represented by C—(X)n or M-C—(X)n, where X refers to any amino acid, (X)n refers to a polypeptide comprising a binding domain, C refers to a cysteine residue, and M refers to a starting methionine.

In certain embodiments of the present invention, the molecule of the present invention comprises an immunoglobulin binding region which lacks cysteine residues. Such immunoglobulin binding region structures are known to the skilled worker and/or can be created using routine methods (see e.g. Proba K, J Mol Biol 275: 245-53 (1998)).

Any of the above binding regions may be used as a component of the cell-targeting molecules of the present invention as long as the binding region component has a dissociation constant of $10^{-5}$ to $10^{-12}$ moles per liter, preferably less than 200 nanomolar (nM), towards an extracellular target biomolecule.

Cell-specific targeting can be accomplished by attaching molecules of the present invention to cell targeting carriers, such as, e.g., liposomes, polymers, nanocarriers, microspheres, nanospheres, dendrimers, polymeric micelles, silicon or carbon materials, such as e.g., nanotubes, nanorods and nanohorns, magnetic nanoparticles, microemulsions, and other nanostructures (Sinha R et al., *Molecular Cancer Therapeutics* 5: 1909-17 (2006); L Brinton et al., *Journal of the National Cancer Institute* 100: 1643-8 (2008); Tanaka T et al., *Biomed Micro Devices* 11: 49-63 (2009)). Attachment may be accomplished using one or more covalent bonds and/or encapsulation.

Extracellular Target Biomolecules

The binding region of the molecule of the invention comprises a polypeptide region capable of binding specifically to an extracellular target biomolecule, preferably which is physically-coupled to the surface of a cell type of interest, such as a cancer cell, tumor cell, plasma cell, infected cell, or host cell harboring an intracellular pathogen.

The term "target biomolecule" refers to a biological molecule, commonly a protein or a protein modified by post-translational modifications, such as glycosylation, which is capable of being bound by a binding region to target a protein to a specific cell-type or location within an organism. Extracellular target biomolecules may include various epitopes, including unmodified polypeptides, polypeptides modified by the addition of biochemical functional groups, and glycolipids.

There are numerous extracellular target biomolecules known to the skilled worker that may be targeted by the binding region of a cell-targeting molecule of the present invention and polypeptide binding domains known to bind such target biomolecules (see e.g. WO 2014/164680; WO 2014/164693; WO 2015/113005; WO 2015/113007; WO 2015/138435; WO 2015/138452; US20150259428; WO 2015/191764; US20160177284; WO 2016/126950).

For purposes of the present invention, the term "extracellular" with regard to modifying a target biomolecule refers to a biomolecule that has at least a portion of its structure exposed to the extracellular environment. Extracellular target biomolecules include cell membrane components, transmembrane spanning proteins, cell membrane-anchored biomolecules, cell-surface-bound biomolecules, and secreted biomolecules.

With regard to the present invention, the phrase "physically coupled" when used to describe a target biomolecule means both covalent and/or non-covalent intermolecular interactions that couple the target biomolecule, or a portion thereof, to the outside of a cell, such as a plurality of non-covalent interactions between the target biomolecule and the cell where the energy of each single interaction is on the order of about 1-5 kiloCalories (e.g. electrostatic bonds, hydrogen bonds, Van der Walls interactions, hydrophobic forces, etc.). All integral membrane proteins can be found physically coupled to a cell membrane, as well as peripheral membrane proteins. For example, an extracellular target biomolecule might comprise a transmembrane spanning region, a lipid anchor, a glycolipid anchor, and/or be non-covalently associated (e.g. via non-specific hydrophobic interactions and/or lipid binding interactions) with a factor comprising any one of the foregoing.

The binding regions of the cell-targeting molecules of the present invention may be designed or selected based on numerous criteria, such as the cell-type specific expression of their target biomolecules and/or the physical localization of their target biomolecules with regard to specific cell types. For example, certain cell-targeting molecules of the present invention comprise binding domains capable of binding cell-surface targets which are expressed exclusively by only one cell-type to the cell surface.

Among certain embodiments of the present invention, the cell-targeting molecule comprises a binding region derived from an immunoglobulin-type polypeptide selected for specific and high-affinity binding to a surface antigen on the cell surface of a cancer cell, where the antigen is restricted in expression to cancer cells (see Glokler J et al., *Molecules* 15: 2478-90 (2010); Liu Y et al., *Lab Chip* 9: 1033-6 (2009)). In accordance with other embodiments, the binding region is selected for specific and high-affinity binding to a surface antigen on the cell surface of a cancer cell, where the antigen is over-expressed or preferentially expressed by cancer cells as compared to non-cancer cells. Some representative target biomolecules include, but are not limited to, the following enumerated targets associated with cancers and/or specific immune cell types.

Many immunoglobulin-type binding regions that recognize epitopes associated with cancer cells exist in the prior art, such as binding regions that target annexin AI, B3 melanoma antigen, B4 melanoma antigen, B7-H3 (CD276, B7RP-2), B-cell maturation antigen (BCMA, BCM, TNRSF17, CD269), CD2, CD3, CD4, CD19, CD20 (B-lymphocyte antigen protein CD20), CD22, CD25 (interleukin-2 receptor IL2R), CD30 (TNFRSF8), CD37, CD38 (cyclic ADP ribose hydrolase), CD40, CD44 (hyaluronan receptor), protein tyrosine phosphatase receptor type C (CD45, PTPRC, LCA), ITGAV (CD51), CD56, CD66, CD70, CD71 (transferrin receptor), CD73, CD74 (HLA-DR antigens-associated invariant chain), CD79 (e.g. CD79a or CD79b), CD98, endoglin (END, CD105), CD106 (VCAM-1), CD138, chemokine receptor type 4 (CDCR-4, fusin, CD184), CD200, insulin-like growth factor 1 receptor (CD221), mucin1 (MUC1, CD227, CA6, CanAg), basal cell adhesion molecule (B-CAM, CD239), CD248 (endosialin, TEM1), tumor necrosis factor receptor 10b (TNFRSF10B, CD262), tumor necrosis factor receptor 13B (TNFRSF13B, TACI), vascular endothelial growth factor receptor 2 (KDR, CD309), epithelial cell adhesion molecule (EpCAM, CD326), human epidermal growth factor receptor 2 (HER2, Neu, ErbB2, CD340), cancer antigen 15-3 (CA15-3), cancer antigen 19-9 (CA 19-9), cancer antigen 125 (CA125, MUC16), CA242, carcinoembryonic antigen-related cell adhesion molecules (e.g. CEACAM3 (CD66d) and CEACAM5), carcinoembryonic antigen protein (CEA), choline transporter-like protein 4 (SLC44A4), chondroitin sulfate proteoglycan 4 (CSP4, MCSP, NG2), CTLA4, delta-like proteins (e.g. DLL3, DLL4), ectonucleotide pyrophosphatase/phosphodiesterase proteins (e.g. ENPP3), endothelin receptors (ETBRs), epidermal growth factor receptor (EGFR, ErbB1), Epstein-Barr virus latent membrane protein 1 (LMP1), folate receptors (FOLRs, e.g. FRa), G-28, ganglioside GD2, ganglioside GD3, HLA-Dr10, HLA-DRB, human epidermal growth factor receptor 1 (HER1), HER3/ErbB-3, Ephrin type-B receptor 2 (EphB2), epithelial cell adhesion molecule (EpCAM), fibroblast activation protein (FAP/seprase), guanylyl cyclase c (GCC), insulin-like growth factor 1 receptor (IGF1R), interleukin 2 receptor (IL-2R), interleukin 6 receptor (IL-6R), integrins alpha-V beta-3 ($\alpha v\beta 3$), integrins alpha-V beta-5 ($\alpha v\beta 5$), integrins alpha-5 beta-1 ($\alpha_5\beta_1$), L6, zinc transporter (LIV-1), MPG, melanoma-associated antigen 1 protein (MAGE-1), melanoma-associated antigen 3 (MAGE-3), mesothelin (MSLN), metalloreductase STEAP1, MPG, MS4A, NaPi2b, nectins (e.g. nectin-4), p21, p97, polio virus receptor-like 4 (PVRL4), protease-activated-receptors (such as PAR1), prostate-specific membrane antigen proteins (PSMAs), SAIL (C16orf54), SLIT and NTRK-like proteins (e.g. SLITRK6), Thomas-Friedenreich antigen, transmembrane glycoprotein (GPNMB), trophoblast glycoproteins (TPGB, 5T4, WAIF1), and tumor-associated calcium signal transducers (TACSTDs, e.g. Trop-2, EGP-1, etc) (see e.g. Lui B et al., *Cancer Res* 64: 704-10 (2004); Novellino L et al., *Cancer Immunol Immunother* 54: 187-207 (2005); Bagley R et al., *Int J Oncol* 34: 619-27 (2009); Gerber H et al., *mAbs* 1: 247-53 (2009); Beck A et al., *Nat Rev Immunol* 10: 345-52 (2010); Andersen J et al., *J Biol Chem* 287: 22927-37 (2012); Nolan-Stevaux O et al., *PLoS One* 7: e50920 (2012); Rust S et al., *Mol Cancer* 12: 11 (2013); Kim S et al., *Blood Cancer Journal* 5: e316 (2015)). This list of target biomolecules is intended to be non-limiting. It will be appreciated by the skilled worker that any desired target biomolecule associated with a cancer cell or other desired cell type may be used to design or select a binding region to be coupled with a toxin effector polypeptide to produce a cell-targeting molecule of the present invention.

Examples of other target biomolecules which are strongly associated with cancer cells and immunoglobulin-type binding regions known to bind them include BAGE proteins (B melanoma antigens), basal cell adhesion molecules (BCAMs or Lutheran blood group glycoproteins), bladder tumor antigen (BTA), cancer-testis antigen NY-ESO-1, cancer-testis antigen LAGE proteins, CD19 (B-lymphocyte antigen protein CD19), CD21 (complement receptor-2 or complement 3d receptor), CD26 (dipeptidyl peptidase-4, DPP4, or adenosine deaminase complexing protein 2), CD33 (sialic acid-binding immunoglobulin-type lectin-3), CD52 (CAMPATH-1 antigen), CD56, CS1 (SLAM family number 7 or SLAMF7), cell surface A33 antigen protein (gpA33), Epstein-Barr virus antigen proteins, GAGE/PAGE proteins (melanoma associated cancer/testis antigens), hepatocyte growth factor receptor (HGFR or c-Met), MAGE proteins, melanoma antigen recognized by T-cells 1 protein (MART-1/MelanA, MARTI), mucins, Preferentially Expressed Antigen of Melanoma (PRAME) proteins, prostate specific antigen protein (PSA), prostate stem cell antigen protein (PSCA), Receptor for Advanced Glycation Endroducts (RAGE), tumor-associated glycoprotein 72 (TAG-72), vascular endothelial growth factor receptors (VEGFRs), and Wilms' tumor antigen.

Examples of other target biomolecules which are strongly associated with cancer cells are carbonic anhydrase IX (CA9/CAIX), claudin proteins (CLDN3, CLDN4), ephrin type-A receptor 3 (EphA3), folate binding proteins (FBP), ganglioside GM2, insulin-like growth factor receptors, integrins (such as CD11a-c), receptor activator of nuclear factor kappa B (RANK), receptor tyrosine-protein kinase erB-3, SAIL (C16orf54), tumor necrosis factor receptor 10A (TRAIL-R1/DR4), tumor necrosis factor receptor 10B (TRAIL-R2), tenascin C, and CD64 (FcγRI) (see Hough C et al., *Cancer Res* 60: 6281-7 (2000); Thepen T et al., *Nat Biotechnol* 18: 48-51 (2000); Pastan I et al., *Nat Rev Cancer* 6: 559-65 (2006); *Pastan, Annu Rev Med* 58: 221-37 (2007); Fitzgerald D et al., *Cancer Res* 71: 6300-9 (2011); Scott A et al., *Cancer Immun* 12: 14-22 (2012); Kim S et al., *Blood Cancer Journal* 5: e316 (2015)). This list of target biomolecules is intended to be non-limiting.

In addition, there are numerous other examples of contemplated, target biomolecules such as ADAM metalloproteinases (e.g. ADAM-9, ADAM-10, ADAM-12, ADAM-15, ADAM-17), ADP-ribosyltransferases (ART1, ART4), antigen F4/80, bone marrow stroma antigens (BST1, BST2), break point cluster region-c-abl oncogene (BCR-ABL) proteins, C3aR (complement component 3a receptors), CD7, CD13, CD14, CD15 (Lewis X or stage-specific embryonic antigen 1), CD23 (FC epsilon RII), CD49d, CD53, CD54 (intercellular adhesion molecule 1), CD63 (tetraspanin), CD69, CD80, CD86, CD88 (complement component 5a receptor 1), CD115 (colony stimulating factor 1 receptor), IL-1R (interleukin-1 receptor), CD123 (interleukin-3 receptor), CD129 (interleukin 9 receptor), CD183 (chemokine receptor CXCR3), CD191 (CCR1), CD193 (CCR3), CD195 (chemokine receptor CCR5), CD203c, CD225 (interferon-induced transmembrane protein 1), CD244 (Natural Killer Cell Receptor 2B4), CD282 (Toll-like receptor 2), CD284 (Toll-like receptor 4), CD294 (GPR44), CD305 (leukocyte-associated immunoglobulin-like receptor 1), ephrin type-A receptor 2 (EphA2), FceRIa, galectin-9, alpha-fetoprotein antigen 17-A1 protein, human aspartyl (asparaginyl) beta-hydroxylase (HAAH), immunoglobulin-like transcript ILT-3, lysophosphatidlglycerol acyltransferase 1 (LPGAT1/IAA0205), lysosome-associated membrane proteins (LAMPs, such as CD107), melanocyte protein PMEL (gp100), myeloid-related protein-14 (mrp-14), NKG2D ligands (e.g., MICA, MICB, ULBP1, ULBP2, UL-16-binding proteins, H-60s, Rae-1s, and homologs thereof), receptor tyrosine-protein kinase erbB-3, SART proteins, scavenger receptors (such as CD64 and CD68), Siglecs (sialic acid-binding immunoglobulin-type lectins), syndecans (such as SDC1 or CD138), tyrosinase, tyrosinease-related protein 1 (TRP-1), tyrosinease-related protein 2 (TRP-2), tyrosinase associated antigen (TAA), APO-3, BCMA, CD2, CD3, CD4, CD8, CD18, CD27, CD28, CD29, CD41, CD49, CD90, CD95 (Fas), CD103, CD104, CD134 (OX40), CD137 (4-1BB), CD152 (CTLA-4), chemokine receptors, complement proteins, cytokine receptors, histocompatibility proteins, ICOS, interferon-alpha, interferon-beta, c-myc, osteoprotegerin, PD-1, RANK, TACI, TNF receptor superfamily member (TNF-R1, TNFR-2), Apo2/TRAIL-R1, TRAIL-R2, TRAIL-R3, and TRAIL-R4 (see Scott A et al., *Cancer Immunity* 12: 14 (2012); Cheever M et al., *Clin Cancer Res* 15: 5323-37 (2009)), for target biomolecules and note the target molecules described therein are non-limiting examples). It will be appreciated by the skilled worker that any desired target biomolecule may be used to design or select a binding region to be coupled with a toxin effector polypeptide to produce a cell-targeting molecule of the present invention.

In certain embodiments, the binding region comprises or consists essentially of an immunoglobulin-type polypeptide selected for specific and high-affinity binding to the cellular surface of a cell type of the immune system. For example, immunoglobulin-type binding domains are known that bind to programmed death ligand 1 (PD-L1), CD1, CD2, CD3, CD4, CD5, CD6, CD7, CD8, CD9, CD10, CD11, CD12, CD13, CD14, CD15, CD16, CD17, CD18, CD19, CD20, CD21, CD22, CD23, CD24, CD25, CD26, CD27, CD28, CD29, CD30, CD31, CD33, CD34, CD35, CD36, CD37, CD38, CD40, CD41, CD56, CD61, CD62, CD66, CD95, CD117, CD123, CD235, CD146, CD326, interleukin-2 receptor (IL-2R), receptor activator of nuclear factor kappa B (RANKL), SLAM-associated protein (SAP), and TNF SF18 (tumor necrosis factor ligand 18 or GITRL).

Extracellular target biomolecules of the binding region of the cell-targeting molecules of the present invention may include biomarkers over-proportionately or exclusively present on cancer cells, immune cells, and cells infected with intracellular pathogens, such as viruses, bacteria, fungi, prions, or protozoans.

This general structure is modular in that any number of diverse cell-targeting binding regions may be linked to one or more toxin effector polypeptides to produce a cell-targeting molecule of the present invention, and compositions thereof.

C. Toxin Effector Polypeptides Derived from Toxins

In certain embodiments, the cell-targeting molecule of the present invention comprises a toxin effector polypeptide region derived from a proteinaceous toxin other than a Shiga toxin(s). In certain embodiments, the cell-targeting molecule of the present invention does not comprise a Shiga toxin effector polypeptide. In certain embodiments, the cell-targeting molecule of the present invention comprises a toxin effector region derived from a toxin other than a member of the Shiga toxin family, such as, e.g., from an ABx toxin other than a Shiga toxin, a ribosome inactivating protein toxin other than Shiga toxin, abrin, anthrax toxin, Aspfl, bouganin, bryodin, cholix toxin, claudin, diphtheria toxin, gelonin, heat-labile enterotoxin, mitogillin, pertussis toxin, pokeweed antiviral protein, pulchellin, *Pseudomonas* exotoxin A, restrictocin, ricin, saporin, sarcin, and subtilase cytotoxin (see e.g., WO 2015/113005; WO 2015/120058). In certain embodiments, the cell-targeting molecule of the present invention does not comprise either a toxin effector region or any polypeptide derived from a toxin.

In certain embodiments, the cell-targeting molecule of the present invention comprises a toxin effector polypeptide which is not a Shiga toxin effector polypeptide. The present invention contemplates the use of various polypeptides derived from toxins as toxin effector polypeptides. For example, many toxins represent optimal sources of cytotoxic polypeptides and/or proteasome delivering effector polypeptides because of the wealth of knowledge about their intracellular routing behaviors (see e.g. WO 2015/113005). Any protein toxin with the intrinsic ability to intracellularly route from an early endosomal compartment to either the cytosol or the ER represents a source for a proteasome delivery effector polypeptide which may be exploited for the purposes of the present invention, such as a starting component for modification or as a source for mapping a smaller proteasome delivery effector region therein.

In certain embodiments, the cell-targeting molecule of the present invention comprises a toxin effector lacking any lysine residues or comprising exactly one lysine residue for site-specific conjugation. The catalytic domains of many toxins, especially toxins which use retrograde routing pathways via the endoplasmic reticulum, are devoid of lysine residues (DeLange R et al., *Proc Natl Acad Sci USA* 73: 69-72 (1976); London E, Luongo C, *Biochem Biophys Res Commun* 160: 333-9 (1989); Hazes B, Read R, *Biochemistry* 36: 11051-4 (1997); Deeks E et al., *Biochemistry* 41: 3405-13 (2002); Worthington Z, Carbonetti N, *Infect Immun* 75: 2946-53 (2007)).

In certain embodiments, the cell-targeting molecule of the present invention comprises the toxin effector polypeptide which is a Shiga toxin effector polypeptide. In certain further embodiments, the Shiga toxin effector polypeptide is a SLT-1A-Cys1-variant (e.g. SEQ ID NOs: 5, 15, 25, 35, 45, 55, 65, and 75). In certain further embodiments, the Shiga toxin effector polypeptide is carboxy-terminal to another proteinaceous component of the cell-targeting molecule (e.g. a cell-targeting binding region or starting methionine) such that the cysteine residue at position 1 of the Shiga toxin effector polypeptide (C1) forms a peptide bond via its amino group.

The general structure of the cell-targeting molecules of the present invention is modular, in that various, diverse binding regions may be used with the same toxin effector polypeptide (e.g. a Shiga toxin effector polypeptide of the present invention) to provide for diverse targeting of various extracellular target biomolecules and thus targeting of cytotoxicity, cytostasis, and/or exogenous material delivery to various diverse cell types. In the cell-targeting molecules of the invention, the binding region(s) and Shiga toxin effector polypeptide(s) may be directly linked to each other and/or suitably linked to each other via one or more linkers well known in the art. For the purposes of the cell-targeting molecules of the present invention, the specific order or orientation is not fixed for the toxin effector polypeptide and the cell-targeting, binding region in relation to each other (see e.g. FIG. 1-B). Toxin effector polypeptides which are not cytotoxic may still be useful for delivering exogenous materials into cells, certain subcellular compartments, and/or providing efficient subcellular routing to the cytosol. Optionally, a cell-targeting molecule of the present invention may further comprise a carboxy-terminal endoplasmic retention/retrieval signal motif, such as, e.g., the amino acids KDEL (SEQ ID NO:1142) at the carboxy-terminus of a proteinaceous component of the cell-targeting molecule (see e.g. WO 2015/138435).

D. Amino Acid Residues and Structures Amenable for Site-Specific Conjugation

Any amino acid residue having a bio-orthogonal reactive moiety (e.g. a side chain or functional group) may be suitable as conjugation site in the molecules of the present invention. The skilled worker can select an amenable and suitable amino acid from the prior art or using routine techniques can identify through experimentation a novel amino acid which is amenable and suitable for use in a molecule of the present invention. In certain embodiments, a molecule of the present invention comprises a Shiga toxin effector polypeptide having a unique amino acid residue, which may be either ectoptically positioned or naturally occurring at that position. In certain other embodiments, the invention may involve a unique amino acid or a non-unique amino acid residue which is uniquely accessible, i.e. not buried in the interior of a proteinaceous structure as are all other) residues of the same amino acid type.

In certain embodiments of the present invention, a single lysine, histidine, or cysteine is engineered into a cell-targeting molecule to provide a specific residue site for conjugation of another molecule. In general, the strongly nucleophilic functional groups of the amino acids lysine, histidine, and cysteine make these three amino acid residues the most amenable attachment points for chemically conjugating of an atom or molecule to a protein. However, the number of lysines, histidines, and/or cysteines vary from protein to protein, which affects the suitability of site-specific attachment and/or control of conjugate stoichiometry. In the examples below, all the cysteine residues were removed from a parental, Shiga toxin A Subunit polypeptide. Then, an ectopic cysteine residue was engineered into the polypeptide to provide a unique attachment position for controlled conjugation. This was repeated at different positions to provide a group of cysteine-engineered Shiga toxin effector polypeptides, and these polypeptides are tested for retention of Shiga toxin effector functions and ability to deliver a conjugated molecule to the inside of a cell.

In certain embodiments of the present invention, a single, unnatural amino acid residue is engineered into a cell-targeting molecule to provide a specific residue site for conjugation of another molecule (see e.g. Liu W et al., *Nat Methods* 4: 239-44 (2007); Liu C, Schultz P, *Annu Rev Biochem* 79: 413-44 (2010); Young T et al., *J Mol Biol* 395: 361-74 (2010); Young T, Schultz P, *J Biol Chem* 285: 11039-44 (2010); Young D et al., *Biochemistry* 50: 1894-900 (2011); Hoesl M, Budisa N, *Curr Opin Biotechnol* 23: 751-7 (2012); Ozawa K et al., *Biochem Biophys Res Commun* 418: 652-6 (2012); Chin J, *Annu Rev Biochem* 83: 379-408 (2014); Ozawa K, Loh C, *Methods Mol Biol* 1118: 189-203 (2014)). For example, unnatural amino acid residues such as selenocysteine and para-acetylphenylalanine, are known in the art to provide useful conjugation sites. Similarly, amino acid residues having an azide group can be used for site specific conjugation.

In certain embodiments of the present invention, the site-specific attachment site is the primary amine or carboxy-terminal of a polypeptide component of the cell-targeting molecule of the present invention.

In certain embodiments of the present invention, a short polypeptide motif is engineered into a cell-targeting molecule to provide a specific residue site for conjugation of another molecule. For example, cysteine residues in certain motifs like CxPxR can be modified by formylglycine generating enzymes into formylglycine, and then the resulting aldehyde functional group may be conjugated to another molecule using hydrozino-Pictet-Spengler chemistry (see e.g. Carrico I et al., *Nat Chem Biol* 3: 321-2 (2007); Rabuka D, et al., *Nat Protoc* 7: 1052-67 (2012)).

It is important to note that the solvent accessibility of the engineered residue may affect its ability to provide a suitable conjugation site; however, suitability may vary with the conjugated molecule and specific application of the resulting conjugate. For example, the size and steric hindrances of the conjugated molecule may affect the stability of the final conjugated product such that certain engineered sites and/or ectopic residues are suitable for certain conjugated molecules but not others. While highly solvent accessible amino acid residues may be predicted to provide better sites for conjugation, it is important to note that the Shiga toxin effector polypeptide or cell-targeting molecule with the greatest therapeutic utility may require a conjugation site which is less solvent accessible than other possible conjugation sites (see e.g. Shen B et al., *Nat Biotechnol* 30: 184-9 (2012)).

There are several common conjugation strategies for linking a proteinaceous molecule to another molecule, such as, e.g., via a lysine in a protein to an amine-reactive linker or molecule, via a cysteine in a protein to a sulfhydryl reactive linker or molecule (e.g. involving an activated maleimide group), via enzyme-mediated conjugation, and/or via the incorporation of an unnatural amino acid such as para-acetylphenylalanine (see e.g. Kline T et al., *Pharm Res* 32: 3480-93 (2015)). For example, sulfhydryl-reactive chemical groups are highly amenable to conjugation chemistry, such as via alkylation (usually the formation of a thioether bond) or disulfide exchange (formation of a disulfide bond). Non-limiting examples of sulfhyryl-reactive groups include haloacetyls, maleimides, aziridines, acryloyls, arylating agents, vinylsulfones, pyridyl disulfides, TNB-thiols and disulfide reducing agents. For example, a cysteine residue can be conjugated to another molecule, e.g., using maleimide or bromoacetamide groups on linkers or cargos and/or using click chemistry. Unnatural amino acid residues can be conjugated using oxime groups on linkers or cargos and/or via click chemistry. For example, para-acetylphenylalanine can be conjugated to another molecule comprising an alkoxy-amine via oxime ligation. For example, selenocysteine can be conjugated to another molecule using maleimide groups and/or click chemistry (see e.g. Hofer T et al., *Biochemistry* 48: 12047-57 (2009); Young T et al., *J Mol Biol* 395: 361-74 (2010); Kiick K et al., *Proc Natl Acad Sci USA* 99: 19-24 (2002)).

For certain embodiments, the molecule of the present invention is made using a haloalkyl derivative, such as, e.g., an iodoacetamide or maleimide, present in the cargo or linker to link the cargo to a cysteine, methionine, and/or histidine residue(s) present in a polypeptide component of a molecule of the present invention. In certain embodiments, a maleimide agent is specifically used to avoid conjugation to a tyrosine, histidine, and/or methionine residue(s).

A cysteine residue already present in a polypeptide component of a molecule of the present invention may be used, such as, e.g., after a reduction reaction to make free its thiol group and make it available for conjugation. The skilled worker can reduce a thiol linkage using methods known in the art, such as, e.g., using TCEP (tris(2-carboxyethyl) phosphine hydrochloride, dithiothreitol (DTT), and/or beta-mercaptoethanol (BME).

For certain embodiments, the molecule of the present invention is made using a nitrosylated thiol derivative, such as, e.g., a thiosulfate, present in the cargo or linker to link the cargo to a cysteine, methionine, and/or histidine residue(s) present in a polypeptide component of a molecule of the present invention.

For certain embodiments, a homobifunctional maleimide, homobifunctional sulfhydryl-reactive maleimide, heterobifunctional maleimide, and/or heterobifunctional amine-to-sulfhydryl maleimide crosslinker(s).

For certain embodiments, a haloacetyl reagent is used, such as, e.g., a haloacetyl crosslinker contain an iodoacetyl or a bromoacetyl group and/or using a NHS ester amine-to sulfhydryl crosslinker. For certain embodiments, an iodoacetyl reactive group is used for chemical conjugation to a sulfhydryl group, such as, e.g., a homobifunctional or heterobifunctional iodoacetyl crosslinker. For certain embodiments a bromoacetyl reactive group is used for chemical conjugation to a sulfhydryl group, such as, e.g., a homobifunctional or heterobifunctional bromoacetyl crosslinker.

For certain embodiments, a sulfhydryl group is added using a chemical reaction, such as, e.g., using 2-iminothiolane, SATA, SATP, $SAT(PEG)_4$, or a pyridyl disulfide. In certain embodiments, the cell-targeting molecule is treated with Traut's Reagent (2-iminothiolane, 2-IT) or SATA to add sulfhydryl groups onto primary amine sites.

In certain embodiments, the linking to the Shiga toxin effector polypeptide involves a chemical reaction involving a sulfhydryl group, such as, e.g., a sulfhydryl group of a cysteine, methionine, N-formylmethionine, homocysteine, or taurine residue of the Shiga toxin effector polypeptide, the linker connecting the Shiga toxin effector polypeptide to a cell-targeting binding region, or the cargo being conjugated.

Chemical reactions suitable for use in conjugating an atom or molecule to a polypeptide or polypeptide component of the present invention include: carbodiimide-mediated reaction, EDC-mediated amide bond formation, hydrazide activation reaction, pyridyl disulfide reaction, iodoacetyl reaction, and/or the Mannich reaction.

For example, a carboxyl group of a polypeptide or polypeptide component of the present invention may be linked to a cargo via a carbodiimide-mediated reaction, such as, e.g., using a water-soluble carbodiimide crosslinker, that results in amide bond formation with an amino, amine, and/or hydrazine group of the cargo. The carboxyl group of the polypeptide may be part of a surface accessible amino acid residue, such as, e.g., the carboxy-terminal residue, an aspartic acid, and/or glutamic acid.

For examples, EDC-mediated amide bond formation may be used for the linking of a carboxylate group of a cargo with the primary amine group of the amino-terminal amine group of a polypeptide or polypeptide component of the present invention. Alternatively, EDC-mediated amide bond formation may be used for the linking of an amine group of a cargo with the carboxy-terminal carboxylate group of a polypeptide or polypeptide component of the present invention. The skilled worker may then use a purification step(s) to further isolate and purify the desired conjugate molecule(s).

For example, the Mannich reaction may be used for the condensation of an aldehyde group of a cargo with the active hydrogen of an amine group of an amino acid residue, such as, e.g., an amine group of an arginine, histidine, lysine, asparagine, glutamine, proline, or tryptophan residue, and/or the amino-terminal amine group of a polypeptide or polypeptide component of the present invention. The skilled worker may then use a purification step(s) to further isolate and purify the desired conjugate molecule(s).

For example, a pyridyl disulfide of a cargo or linker may be used to react with a sulfhydryl group of a polypeptide or polypeptide component of the present invention. The pyridyl disulfide may be pre-activated via other chemical reactions before the coupling reaction between the cargo and the protein or polypeptide component of the present invention.

For example, an iodoacetyl of a cargo may be used to react with a sulfhydryl group of a polypeptide or polypeptide component of the present invention. The pyridyl disulfide may be pre-activated via other chemical reactions before the coupling reaction between the cargo and the protein or polypeptide component of the present invention.

In certain embodiments, the cargo and Shiga toxin effector polypeptide of the present invention are linked via a disuccinimidyl suberate (DSS) linker.

E. Linkers for Conjugating Polypeptide Components of the Present Invention to a Heterologous Molecule, Cargo, and/or Additional Exogenous Material In certain embodiments, the molecule of the present invention comprises a conjugated molecule, such as, e.g., a heterologous molecule, a cargo, an additional exogenous material, and/or a cell-targeting molecule altering agent. In certain further embodiments, the molecule of the present invention is indirectly conjugated via one or more linkers, referred to herein as a "conjugation linker." The skilled worker can select conjugation linker from the prior art or using routine techniques can identify through experimentation a novel conjugation linker suitable for use in a molecule of the present invention. In certain embodiments, the conjugation linkage involves an amine reactive compound and/or a sulfhydryl reactive compound, such as, e.g., a thiol.

Conjugation linkers are generally those which allow stable linkage of the conjugate molecule to a Shiga toxin effector polypeptide and/or proteinaceous component of the cell-targeting molecule of the present invention. Stability in this sense refers to both during storage and in the circulatory system of a vertebrate; however, in certain embodiments the conjugation linker allows for the selective dissociation of the conjugate molecule from the linker and/or the remainder of the cell-targeting molecule, and/or the degradation of the linker thereby breaking the linkage between the conjugate molecule and the remainder of the cell-targeting molecule.

For example, suitable conjugation linkers known to the skilled worker include or involve hydrazone linkages, thioether linkages, disulfide linkages, proteolytically-cleaved linkers, valine-citrulline linkers, β-glucuronide linkers, self-immolative linkages, reversible amino-thiol linkages, and SpaceLink linkers (see e.g. Højfeldt J et al., *J Org Chem* 71: 9556-9 (2006); Ducry L, Stump B, *Bioconjugate Chem* 21: 5-13 (2010)).

In certain embodiments, a molecule of the present invention comprises the conjugation linker which is homobifunctional, whereas in other embodiments, the conjugation linker is heterobifunctional. Examples of homobifunctional linkers suitable for use in certain embodiments of the present invention include NHS esters, haloacetly, aryl azide, diazirine, imidoesters, carbodiimide, maleimide, hydrazide, pyridyldithiol, isocyanate, psoralen. In certain embodiments, the conjugation linker comprises a polyethylene glycol (PEG) spacer. Examples of homobifunctional and/or heterobifunctional linkers suitable for use in certain embodiments of the present invention include bis(sulfosuccinimidyl) suberate, dissuccinimidyl suberate, bis(succinimidyl) penta (ethylene glycol), bis(succinimidyl) nona (ethylene glycol), m-maleimidobenzoyl-N-hydroxysulfosuccinimide ester, 2-pyridyldithiol-tetraoxaoctatriacontane-N-hydrosuccinimide, and succinimidyl-[(N-maleimidopropionamido)-tetracosaethyleneglycol]ester.

In certain embodiments, a molecule of the present invention comprises a maleimide type conjugation linker. In certain further embodiments, a molecule of the present invention comprises a dibenzocyclooctyne (DBCO) maleimide linker linking a cargo molecule to a proteinaceous component of the cell-targeting molecule, such as, e.g., via a cysteine residue in the proteinaceous component.

In certain embodiments, the conjugation linker is conjugated to another molecule via a disulfide bond(s) having a sterically-hindered carbon(s) near the sulfur atom(s) (see e.g. Erickson H et al., *Cancer Res* 66: 4426-33 (2006)).

In certain embodiments, the conjugation linker is a disulfide type linker (see e.g. Hamilton G, *Biologicals* 43: 318-32 (2015)).

In certain embodiments of the present invention, the components of a Shiga toxin effector polypeptide (e.g. a cargo or to a Shiga toxin effector polypeptide) or cell-targeting molecule (e.g. a binding region to a toxin effector polypeptide) may be suitably linked to each other via one or more linkers well known in the art and/or described herein, such as, e.g., proteinaceous linkers capable of being genetically fused between other proteinaceous components of the cell-targeting molecules of the present invention.

Suitable linkers are generally those which allow each polypeptide component of the present invention to fold with a three-dimensional structure very similar to the polypeptide components produced individually without any linker or other component. Suitable linkers include single amino acids, peptides, polypeptides, and linkers lacking any of the aforementioned such as various non-proteinaceous carbon chains, whether branched or cyclic (see e.g. Alley S et al., *Bioconjug Chem* 19: 759-65 (2008) Ducry L, Stump B, *Bioconjug Chem* 21: 5-13 (2010); Chen X et al., *Adv Drug Deliv Rev* 65: 1357-69 (2013)).

Suitable linkers may be proteinaceous and comprise one or more amino acids, peptides, and/or polypeptides. Proteinaceous linkers are suitable for both recombinant fusion proteins and chemically linked conjugates. A proteinaceous linker typically has from about 2 to about 50 amino acid residues, such as, e.g., from about 5 to about 30 or from about 6 to about 25 amino acid residues. The length of the linker selected will depend upon a variety of factors, such as, e.g., the desired property or properties for which the linker is being selected (see e.g. Chen X et al., *Adv Drug Deliv Rev* 65: 1357-69 (2013)).

Suitable linkers may be non-proteinaceous, such as, e.g. chemical linkers (see e.g. Dosio F et al., *Toxins* 3: 848-83 (2011); Feld J et al., *Oncotarget* 4: 397-412 (2013)). Various non-proteinaceous linkers known in the art may be used to link cell-targeting moieties to toxin effector polypeptide and other components to form a cell-targeting molecule of the present invention, such as linkers commonly used to conjugate immunoglobulin-derived polypeptides to heterologous polypeptides. For example, polypeptide regions of the cell-targeting molecules of the present invention may be linked using the functional side chains of their amino acid residues and carbohydrate moieties such as, e.g., a carboxy, amine, sulfhydryl, carboxylic acid, carbonyl, hydroxyl, and/or cyclic ring groups. For example, disulfide bonds and thioether bonds may be used to link two or more polypeptides (see e.g. Fitzgerald D et al., *Bioconjugate Chem* 1: 264-8 (1990); Pasqualucci L et al., *Haematologica* 80: 546-56 (1995)). In addition, non-natural amino acid residues may be used with other functional side chains, such as ketone groups (see e.g. Axup J et al., *Proc Natl Acad Sci U.S.A.* 109: 16101-6 (2012); Sun S et al., *Chembiochem* Jul. 18 (2014); Tian F et al., *Proc Natl Acad Sci USA* 111: 1766-71 (2014)). Examples of non-proteinaceous chemical linkers include but are not limited to N-succinimidyl (4-iodoacetyl)-aminobenzoate, S—(N-succinimidyl) thioacetate (SATA), N-succinimidyl-oxycarbonyl-α-methyl-α-(2-pyridyldithio) toluene (SMPT), N-succinimidyl 4-(2-pyridyldithio)-pentanoate (SPP), succinimidyl 4-(N-maleimidomethyl) cyclohexane carboxylate (SMCC or MCC), sulfosuccinimidyl (4-iodoacetyl)-aminobenzoate, 4-succinimidyl-oxycarbonyl-α-(2-pyridyldithio) toluene, sulfosuccinimidyl-6-(α-methyl-α-(pyridyldithiol)-toluamido) hexanoate, N-succinimidyl-3-(-2-pyridyldithio)-proprionate (SPDP), succinimidyl 6(3(-(-2-pyridyldithio)-proprionamido) hexanoate, sulfosuccinimidyl 6(3(-(-2-pyridyldithio)-propionamido) hexanoate, maleimidocaproyl (MC), maleimidocaproyl-valine-citrulline-p-aminobenzyloxycarbonyl (MC-vc-PAB), 3-maleimidobenzoic acid N-hydroxysuccinimide ester (MBS), alpha-alkyl derivatives, sulfoNHS-ATMBA (sulfosuccinimidyl N-[3-(acetylthio)-3-methylbutyryl-beta-alanineD, sulfodicholorphenol, 2-iminothiolane, 3-(2-pyridyldithio)-propionyl hydrazide, Ellman's reagent, dichlorotriazinic acid, and S-(2-thiopyridyl)-L-cysteine (see e.g. Thorpe P et al., *Eur J Biochem* 147: 197-206 (1985); Thorpe P et al., *Cancer Res* 47: 5924-31 (1987); Thorpe P et al., *Cancer Res* 48: 6396-403 (1988); Grossbard M et al., *Blood* 79: 576-85 (1992); Lui C et al., *Proc Natl Acad Sci USA* 93: 8618-23 (1996); Doronina S et al., *Nat Biotechnol* 21: 778-84 (2003); Feld J et al., *Oncotarget* 4: 397-412 (2013)).

Suitable linkers, whether proteinaceous or non-proteinaceous, may include, e.g., protease sensitive, environmental redox potential sensitive, pH sensitive, acid cleavable, photocleavable, and/or heat sensitive linkers (see e.g. Dosio F et al., *Toxins* 3: 848-83 (2011); Chen X et al., *Adv Drug Deliv Rev* 65: 1357-69 (2013); Feld J et al., Oncotarget 4: 397-412 (2013)).

Proteinaceous linkers may be chosen for incorporation into recombinant, fusion protein, cell-targeting molecules of the present invention. For recombinant fusion cell-targeting proteins of the invention, linkers typically comprise about 2 to 50 amino acid residues, preferably about 5 to 30 amino acid residues (Argos P, *J Mol Biol* 211: 943-58 (1990); Williamson M, *Biochem J* 297: 240-60 (1994); George R, Heringa J, *Protein Eng* 15: 871-9 (2002); Kreitman R, *AAPS J* 8: E532-51 (2006)). Commonly, proteinaceous linkers comprise a majority of amino acid residues with polar, uncharged, and/or charged residues, such as, e.g., threonine, proline, glutamine, glycine, and alanine (see e.g. Huston J et al. *Proc Natl Acad Sci U.S.A.* 85: 5879-83 (1988); Pastan I et al., *Annu Rev Med* 58: 221-37 (2007); Li J et al., *Cell Immunol* 118: 85-99 (1989); Cumber A et al. *Bioconj Chem* 3: 397-401 (1992); Friedman P et al., *Cancer Res* 53: 334-9 (1993); Whitlow M et al., *Protein Engineering* 6: 989-95 (1993); Siegall C et al., *J Immunol* 152: 2377-84 (1994); Newton et al. *Biochemistry* 35: 545-53 (1996); Ladurner et al. *J Mol Biol* 273: 330-7 (1997); Kreitman R et al., *Leuk Lymphoma* 52: 82-6 (2011); U.S. Pat. No. 4,894,443). Non-limiting examples of proteinaceous linkers include alanine-serine-glycine-glycine-proline-glutamate (ASGGPE) (SEQ ID NO:1190), valine-methionine (VM), alanine-methionine (AM), AM($G_{2\ to\ 4}S$)$_x$AM (SEQ ID NO:1191) where G is glycine, S is serine, and x is an integer from 1 to 10.

Proteinaceous linkers may be selected based upon the properties desired. Proteinaceous linkers may be chosen by the skilled worker with specific features in mind, such as to optimize one or more of the fusion protein's folding, stability, expression, solubility, pharmacokinetic properties, pharmacodynamic properties, and/or the activity of the fused domains in the context of a fusion construct as compared to the activity of the same domain by itself. For example, proteinaceous linkers may be selected based on flexibility, rigidity, and/or cleavability (see e.g. Chen X et al., *Adv Drug Deliv Rev* 65: 1357-69 (2013)). The skilled worker may use databases and linker design software tools when choosing linkers. Certain linkers may be chosen to optimize expression (see e.g. Turner D et al., *J Immunol Methods* 205: 43-54 (1997)). Certain linkers may be chosen to promote intermolecular interactions between identical polypeptides or proteins to form homomultimers or different polypeptides or proteins to form heteromultimers. For example, proteinaceous linkers may be selected which allow for desired non-covalent interactions between polypeptide components of the cell-targeting proteins of the invention, such as, e.g., interactions related to the formation dimers and other higher order multimers (see e.g. U.S. Pat. No. 4,946,778).

Flexible proteinaceous linkers are often greater than 12 amino acid residues long and rich in small, non-polar amino acid residues, polar amino acid residues, and/or hydrophilic amino acid residues, such as, e.g., glycines, serines, and threonines (see e.g. Bird R et al., *Science* 242: 423-6 (1988); Friedman Petal., *Cancer Res* 53: 334-9 (1993); Siegall C et al., *J Immunol* 152: 2377-84 (1994)). Flexible proteinaceous linkers may be chosen to increase the spatial separation between components and/or to allow for intramolecular interactions between components. For example, various "GS" linkers are known to the skilled worker and are composed of multiple glycines and/or one or more serines, sometimes in repeating units, such as, e.g., $(G_xS)_n$ (SEQ ID NO: 1192), $(S_xG)_n$ (SEQ ID NO: 1193), $(GGGGS)_n$ (SEQ ID NO: 1194), and $(G)_n$ (SEQ ID NO: 1195). in which x is 1 to 6 and n is 1 to 30 (see e.g. WO 96/06641). Non-limiting examples of flexible proteinaceous linkers include GKSSGSGSESKS (SEQ ID NO: 1196), GSTSGSGKSSEGKG (SEQ ID NO: 1197), GSTSGSGKSSEGSGSTKG (SEQ ID NO: 1198), GSTSGSGKPGSGEGSTKG (SEQ ID NO: 1199), EGKSSGSGSESKEF (SEQ ID NO: 1200), SRSSG (SEQ ID NO: 1201), and SGSSC (SEQ ID NO: 1202).

Rigid proteinaceous linkers are often stiff alpha-helical structures and rich in proline residues and/or one or more strategically placed prolines (see Chen X et al., *Adv Drug Deliv Rev* 65: 1357-69 (2013)). Rigid linkers may be chosen to prevent intramolecular interactions between linked components.

Suitable linkers may be chosen to allow for in vivo separation of components, such as, e.g., due to cleavage and/or environment-specific instability (see Dosio F et al., *Toxins* 3: 848-83 (2011); Chen X et al., *Adv Drug Deliv Rev* 65: 1357-69 (2013)). The skilled worker knows how to make and use linkers designed to be stable, particularly in extracellular environments like in the blood plasma of a chordate's circulatory system, but to be cleaved in certain intracellular environments having unique characteristics, such as, e.g., in certain cell-types and/or intracellular compartments due to the presence of certain proteolytic activities, redox environments, and/or pH environments, thereby separating linked components of the molecule of the present invention.

In vivo cleavable proteinaceous linkers are capable of unlinking by proteolytic processing and/or reducing environments often at a specific site within an organism or inside a certain cell type (see e.g. Doronina S et al., *Bioconjug Chem* 17: 144-24 (2006); Erickson H et al., *Cancer Res* 66: 4426-33 (2006)). In vivo cleavable proteinaceous linkers often comprise protease sensitive motifs and/or disulfide bonds formed by one or more cysteine pairs (see e.g. Pietersz G et al., *Cancer Res* 48: 4469-76 (1998); The J et al., *J Immunol Methods* 110: 101-9 (1998); see Chen X et al., *Adv Drug Deliv Rev* 65: 1357-69 (2013)). In vivo cleavable proteinaceous linkers may be designed to be sensitive to proteases that exist only at certain locations in an organism, compartments within a cell, and/or become active only under certain physiological or pathological conditions (such as, e.g., proteases with abnormally high levels, proteases overexpressed at certain disease sites, and proteases specifically expressed by a pathogenic microorganism). For example, there are proteinaceous linkers known in the art which are cleaved by proteases present only intracellularly, proteases present only within specific cell types, and proteases present only under pathological conditions like cancer or inflammation, such as, e.g., R-x-x-R motif and AMGRSGGGCAGNRVGSSLSCGGLNLQAM (SEQ ID NO:1203).

In certain embodiments of the cell-targeting molecules of the present invention, a linker may be used which comprises one or more protease sensitive sites to provide for cleavage by a protease present within a target cell. In certain embodiments of the cell-targeting molecules of the invention, a linker may be used which is not cleavable to reduce unwanted toxicity after administration to a vertebrate organism (see e.g. Polson et al., *Cancer Res* 69: 2358-(2009)).

Suitable linkers may include, e.g., protease sensitive, environmental redox potential sensitive, pH sensitive, acid cleavable, photocleavable, and/or heat sensitive linkers, whether proteinaceous or non-proteinaceous (see Chen X et al., *Adv Drug Deliv Rev* 65: 1357-69 (2013)).

Suitable cleavable linkers may include linkers comprising cleavable groups which are known in the art such as, e.g., linkers noted by Zarling D et al., *J Immunol* 124: 913-20 (1980); Jung S, Moroi M, *Biochem Biophys Acta* 761: 152-62 (1983); Bouizar Z et al., *Eur J Biochem* 155: 141-7 (1986); Park L et al., *J Biol Chem* 261: 205-10 (1986); Browning J, Ribolini A, *J Immunol* 143: 1859-67 (1989); Joshi S, Burrows R, *J Biol Chem* 265: 14518-25 (1990); Choi W et al., *J Bioact Compat Polym* 14: 447-56 (1999); Jensen K et al., *Bioconjug Chem* 13: 975-84 (2002); Christie R, Grainger, D, *Adv Drug Deliv Rev* 55: 421-37 (2003)).

Suitable linkers may include pH sensitive linkers. For example, certain suitable linkers may be chosen for their instability in lower pH environments to provide for dissociation inside a subcellular compartment of a target cell. For example, linkers that comprise one or more trityl groups, derivatized trityl groups, bismaleimideothoxy propane groups, adipic acid dihydrazide groups, and/or acid labile transferrin groups, may provide for release of components of the cell-targeting molecules of the invention, e.g. a polypeptide component, in environments with specific pH ranges (see e.g. Welhöner H et al., *J Biol Chem* 266: 4309-14 (1991); Fattom A et al., *Infect Immun* 60: 584-9 (1992)). Certain linkers may be chosen which are cleaved in pH ranges corresponding to physiological pH differences between tissues, such as, e.g., the pH of tumor tissue is lower than in healthy tissues (see e.g. U.S. Pat. No. 5,612,474).

Photocleavable linkers are linkers that are cleaved upon exposure to electromagnetic radiation of certain wavelength ranges, such as light in the visible range (see e.g. Goldmacher V et al., *Bioconj Chem* 3: 104-7 (1992)). Photocleavable linkers may be used to release a component of a cell-targeting molecule of the invention, e.g. a polypeptide component, upon exposure to light of certain wavelengths. Non-limiting examples of photocleavable linkers include a nitrobenzyl group as a photocleavable protective group for cysteine, nitrobenzyloxycarbonyl chloride cross-linkers, hydroxypropylmethacrylamide copolymer, glycine copolymer, fluorescein copolymer, and methylrhodamine copolymer (Hazum E et al., *Pept Proc Eur Pept Symp,* 16th, Brunfeldt K, ed., 105-110 (1981); Senter et al., *Photochem Photobiol* 42: 231-7 (1985); Yen et al., *Makromol Chem* 190: 69-82 (1989); Goldmacher V et al., *Bioconj Chem* 3: 104-7 (1992)). Photocleavable linkers may have particular uses in linking components to form cell-targeting molecules of the invention designed for treating diseases, disorders, and conditions that can be exposed to light using fiber optics.

In certain embodiments of the cell-targeting molecules of the present invention, a cell-targeting binding region is linked to a toxin effector polypeptide using any number of means known to the skilled worker, including both covalent and noncovalent linkages (see e.g. Chen X et al., *Adv Drug Deliv Rev* 65: 1357-69 (2013); *Behrens C, Liu B, MAbs* 6: 46-53 (2014)).

In certain embodiments of the cell-targeting molecules of the present invention, the protein comprises a binding region which is a scFv with a linker connecting a heavy chain variable ($V_H$) domain and a light chain variable ($V_L$) domain. There are numerous linkers known in the art suitable for this purpose, such as, e.g., the 15-residue $(Gly4Ser)_3$ peptide (SEQ ID NO:1204). Suitable scFv linkers which may be used in forming non-covalent multivalent structures include GGS, GGGS (Gly3Ser or G3 S) (SEQ ID NO:1205), GGGGS (Gly4Ser or G45) (SEQ ID NO:1206), GGGGSGGG (SEQ ID NO:1207), GGSGGGG (SEQ ID NO:1208), GSTSGGGSGGGSGGGGSS (SEQ ID NO:1209), and GSTSGSGKPGSSEGSTKG (SEQ ID NO:1210) (Plückthun A, Pack P, *Immunotechnology* 3: 83-105 (1997); Atwell J et al., *Protein Eng* 12: 597-604 (1999); Wu A et al., *Protein Eng* 14: 1025-33 (2001); Yazaki Petal., *J Immunol Methods* 253: 195-208 (2001); Carmichael J et al., *J Mol Biol* 326: 341-51 (2003); Arndt M et al., *FEBS Lett* 578: 257-61 (2004); Bie C et al., *World J Hepatol* 2: 185-91 (2010)).

In certain embodiments of the cell-targeting molecule of the present invention, the molecule comprises a linker between the Shiga toxin effector polypeptide and the binding region wherein the linker has one or more cysteine residues. In certain further embodiments, there is a molecule covalently linked to the cysteine residue via its sulfhydryl functional group.

In certain embodiments of the cell-targeting molecules of the present invention, the cell-targeting molecule comprises the linker comprising or consisting essentially of any one of SEQ ID NOs: 757-761 and 768-772.

In certain embodiments of the cell-targeting molecule of the present invention, the molecule comprises the linker comprising the polypeptide GGGC (SEQ ID NO:1211), such as, e.g., the linker comprising or consisting essentially of GGGGCGG (SEQ ID NO:1212), GGGGSGGGGCGG (SEQ ID NO:1213), GGGGCGGGGSGG (SEQ ID NO:1214), GGGGSGGGGSGGGGC (SEQ ID NO:1215), GGGGSGGGGCGGGGS (SEQ ID NO:1216), GGGGCGGGGCSGGGS (SEQ ID NO:1217), GGGGSGGGGCGGGGSSGGGGSSGGGGS (SEQ ID NO:1218), GGGGCGGGGSGGGGSSGGGGSSGGGGS (SEQ ID NO:1219), GGGGSGGGGSGGGGCSGGGGSSGGGGS (SEQ ID NO:1220), GGGGSGGGGSGGGGSCGGGGSSGGGGS (SEQ ID NO:1221), GGGGSGGGGSGGGGSSGGGGCSGGGGS (SEQ ID NO:1222), GGGGSGGGGSGGGGSSGGGGSCGGGGS (SEQ ID NO:1223), or GGGGSGGGGSGGGGSGGGGSSGGGGC (SEQ ID NO:1224).

In certain embodiments of the cell-targeting molecule of the present invention, the molecule comprises the linker comprising the polypeptide GGGK (SEQ ID NO:1225), such as, e.g., the linker comprising or consisting essentially of GGGGKGG (SEQ ID NO:1226), GGGGSGGGGKGG (SEQ ID NO:1227), GGGGKGGGGSGG (SEQ ID NO:1228), GGGGSGGGGSGGGGK (SEQ ID NO:1229), GGGGSGGGGKGGGGS (SEQ ID NO:1230), GGGGKGGGGCSGGGS (SEQ ID NO:1231), GGGGCGGGGKSGGGS (SEQ ID NO:1232), GGGGSGGGGKGGGGSSGGGGSSGGGGS (SEQ ID NO:1233), GGGGKGGGGSGGGGSSGGGGSSGGGGS (SEQ ID NO:1234), GGGGSGGGGSGGGGKSGGGGSSGGGGS (SEQ ID NO:1235), GGGGSGGGGSGGGGSKGGGGSSGGGGS (SEQ ID NO:1236), GGGGSGGGGSGGGGSSGGGGKSGGGGS (SEQ ID NO:1237), GGGGSGGGGSGGGGSSGGGGSKGGGGS (SEQ ID NO:1238), or GGGGSGGGGSGGGGSGGGGSSGGGGK (SEQ ID NO:1239).

Suitable methods for linkage of the components of the cell-targeting molecules of the present invention may be by any method presently known in the art for accomplishing such, as long as the attachment does not substantially impede the binding capability of the cell-targeting agent or binding region, the cellular internalization of the cell-targeting molecule, the intracellular delivery of a cargo to a subcellular compartment or specific location, and/or the subcellular routing of the toxin effector polypeptide, each of which can be determined by an appropriate assay, including by assays described herein.

F. Cargos, Heterologous Matter, Conjugated Moieties, Cell-Targeting Molecule Altering Agents, and Additional Exogenous Materials In certain embodiments, a molecule of the present invention comprises matter heterologous to Shiga toxins, such as, e.g., a cargo, conjugated molecule, additional exogenous material, and/or cell-targeting molecule altering agent. A molecule conjugated to a cell-targeting molecule represents a conjugated moiety. Such a heterologous matter (e.g. an atom or molecule) linked to a Shiga toxin effector polypeptide may be a matter which is foreign to the target cell and/or is not present in intended target cells in desirable amounts. In certain embodiments, the conjugated matter is an atomic or molecular cargo, heterologous molecule, additional exogenous material, and/or cell-targeting molecule altering agent, such as, e.g., a CD8+ T-cell epitope and/or antigen, radionucleide, peptide, detection-promoting agent, protein, small molecule chemotherapeutic agent, and/or polynucleotide.

In certain embodiments, the conjugated matter is or comprises an atom, such as a radionucleide. In certain embodiments, the radionucleide is $^{211}$At, $^{131}$I, $^{125}$I, $^{90}$Y, $^{111}$In, $^{186}$Re, $^{188}$Re, $^{153}$Sm, $^{212}$Bi, $^{32}$P, $^{60}$C, and/or a radioactive isotope of lutetium.

In certain embodiments, the conjugated matter is a lipid, serum albumin binding molecule, antibiotic, cytotoxic agent, detection-promoting agent, peptide, protein, enzyme, nucleic acid, and/or protein-nucleic acid complex (see e.g. Liu B, *Brief Funct Genomic Proteomic* 6: 112-9 (2007); Endoh T, Ohtsuki T, *Adv Drug Deliv Rev* 61: 704-9 (2009)). In certain embodiments, the cell-targeting molecules of the present invention comprise a conjugated matter which is a molecule altering agent meant to function prior to or during target cell internalization of the cell-targeting molecule. In certain other embodiments, the cell-targeting molecules of the present invention comprise a conjugated matter which is a cargo (e.g. an additional exogenous material) meant to function after target cell internalization of the cell-targeting molecule. In certain embodiments, the cell-targeting molecules of the present invention comprise a conjugated matter which is an additional exogenous material or cargo, such as, e.g., a polypeptide comprising a pro-apoptotic effector like, e.g., fragments of caspase-3, caspase-6, granzyme B, tBid, and apoptosis inducing factor (AIF) (see e.g., Jia L et al., *Cancer Res* 63: 3257-62 (2003); Xu Y et al. *J Immunol* 173: 61-7 (2004); Wang T et al., *Cancer Res* 67: 11830-9 (2007); Shan L et al., *Cancer Biol Ther* 1717-22 (2008); Qiu X et al., *Mal Cancer Ther* 7: 1890-9 (2008)). In certain embodiments, the conjugated matter is a peptide comprising or consisting essentially of a CD8+ T-cell epitope and/or antigen.

Non-limiting examples of cell-targeting molecule altering agents include various polyethylene glycol molecules, lipids, and liposomes because these agents can alter, e.g., the immunogenicity and/or pharmacokinetics of the cell-targeting molecule.

In certain embodiments, the conjugated matter is a non-proteinaceous polymer, e.g., a polyethylene glycol, polypropylene glycol, or polyoxyalkylene (see e.g., U.S. Pat. Nos. 4,179,337; 4,301,144; 4,640,835; 4,670,417; 4,791,192; and 4,496,689). Any one of these can function as a cell-targeting molecule altering agent.

In certain embodiments, the cell-targeting molecule of the present invention comprises a cargo molecule covalently conjugated to an amino acid residue in a proteinaceous component of the cell-targeting molecule. In certain further embodiments, the cell-targeting molecule of the present invention comprises a cargo molecule covalently conjugated to a cysteine, lysine, or histidine residue in the cell-targeting molecule. In certain further embodiments, the cell-targeting molecule of the present invention comprises a cargo molecule covalently conjugated to a Shiga toxin effector polypeptide component of the cell-targeting molecule via a cysteine, lysine, or histidine residue in the Shiga toxin effector polypeptide. In certain further embodiments, the cargo is covalently linked to the cysteine residue via its sulfhydryl functional group. In certain further embodiments, the cargo molecule is released from the cell-targeting molecule upon reaching the endoplasmic reticulum or another compartment having a reducing environment due to the reduction of a disulfide bond between the cargo and the Shiga toxin effector polypeptide (see e.g. El Alaoui A et al., *Angew Chem Int Ed Engl* 46: 6469-72 (2007)).

In certain embodiments, the cell-targeting molecule of the present invention comprises a nucleic acid cargo conjugated to a proteinaceous component of the cell-targeting molecule via a disulfide bond (see e.g. Muratovska A, Eccles M, *FEBS Lett* 558: 63-8 (2004); Ishihara T et al., *Drug Deliv* 16: 153-9 (2009)).

In certain embodiments, the cargo is a protein or polypeptide comprising an enzyme. In certain other embodiments, the cargo is a nucleic acid, such as, e.g. a ribonucleic acid that functions as a small inhibiting RNA (siRNA) or microRNA (miRNA). In certain embodiments, the cargo is an antigen, such as antigens derived from pathogens, bacterial proteins, viral proteins, proteins mutated in cancer, proteins aberrantly expressed in cancer, or T-cell complementary determining regions. For example, cargos may include antigens, such as those antigens presented by antigen-presenting cells infected by bacteria, and T-cell complementary determining regions capable of functioning as exogenous antigens. Cargo molecules comprising polypeptides or proteins may optionally comprise one or more antigens whether known or unknown to the skilled worker.

In certain embodiments of the cell-targeting molecules of the present invention, all heterologous antigens and/or epitopes associated with the Shiga toxin effector polypeptide are arranged in the cell-targeting molecule amino-terminal to the carboxy-terminus of the Shiga toxin A1 fragment region of the Shiga toxin effector polypeptide. In certain further embodiments, all heterologous antigens and/or epitopes associated with the Shiga toxin effector polypeptide are associated, either directly or indirectly, with the Shiga toxin effector polypeptide at a position amino-terminal to the carboxy-terminus of the Shiga toxin A1 fragment region of the Shiga toxin effector polypeptide. In certain further embodiments, all additional exogenous material(s) which is an antigen is arranged amino-terminal to the Shiga toxin effector polypeptide, such as, e.g., fused directly or indirectly to the amino terminus of the Shiga toxin effector polypeptide.

In certain embodiments, the cell-targeting molecule of the present invention comprises a protein-nucleic acid complex cargo conjugated to a proteinaceous component of the cell-targeting molecule via a disulfide bond.

In certain embodiments, the cargo and/or detection-promoting agent is a fluorophore, such as, e.g., a maleimide derivative of an Alexa Fluor® fluorophore for conjugating to a thiol functional group of an amino acid residue of a molecule of the present invention.

In certain embodiments, the cell-targeting molecule of the present invention comprises a zymoxin, which is an inactive viral enzyme that may be activated by proteolytic cleavage (see e.g. Shapira A et al., *PLoS One* 6: e15916 (2011)).

In certain embodiments, the cargo is a proapoptotic peptide, polypeptide, or protein, such as, e.g., BCL-2, caspases (e.g. fragments of caspase-3 or caspase-6), cytochromes, granzyme B, apoptosis-inducing factor (AIF), BAX, tBid (truncated Bid), and proapoptotic fragments or derivatives thereof (see e.g., Ellerby H et al., *Nat Med* 5: 1032-8 (1999); Mai J et al., *Cancer Res* 61: 7709-12 (2001); Jia L et al., *Cancer Res* 63: 3257-62 (2003); Liu Y et al., *Mol Cancer Ther* 2: 1341-50 (2003); Perea S et al., *Cancer Res* 64: 7127-9 (2004); Xu Y et al., *J Immunol* 173: 61-7 (2004); Dalken B et al., *Cell Death Differ* 13: 576-85 (2006); Wang T et al., *Cancer Res* 67: 11830-9 (2007); Kwon M et al., *Mol Cancer Ther* 7: 1514-22 (2008); Qiu X et al, *Mol Cancer Ther* 7: 1890-9 (2008); Shan L et al., *Cancer Biol Ther* 11: 1717-22 (2008); Wang F et al., *Clin Cancer Res* 16: 2284-94 (2010); Kim J et al., *J Virol* 85: 1507-16 (2011)).

In certain embodiments, the cargo is a cytotoxic agent, such as, e.g., a small molecule chemotherapeutic agent, anti-neoplastic agent, cytotoxic antibiotic, alkylating agent, antimetabolite, topoisomerase inhibitor, and/or tubulin inhibitor. Non-limiting examples of cytotoxic agents suitable for use with the present invention include aziridines, cisplatins, tetrazines, procarbazine, hexamethylmelamine, vinca alkaloids, taxanes, camptothecins, etoposide, doxorubicin, mitoxantrone, teniposide, novobiocin, aclarubicin, anthracyclines, actinomycin, amanitin, amatoxins, bleomycin, centanamycin (indolecarboxamide), plicamycin, mitomycin, daunorubicin, epirubicin, idarubicins, dolastatins, maytansines, maytansionoids, duromycin, docetaxel, duocarmycins, adriamycin, calicheamicin, auristatins, pyrrolobenzodiazepines, pyrrolobenzodiazepine dimers (PBDs), carboplatin, 5-fluorouracil (5-FU), capecitabine, mitomycin C, paclitaxel, 1,3-Bis(2-chloroethyl)-1-nitrosourea (BCNU), rifampicin, cisplatin, methotrexate, gemcitabine, aceglatone, acetogenins (e.g. bullatacin and bullatacinone), aclacinomysins, AG1478, AG1571, aldophosphamide glycoside, alkyl sulfonates (e.g., busulfan, improsulfan, and piposulfan), alkylating agents (e.g. thiotepa and cyclosphosphamide), aminolevulinic acid, aminopterin, amsacrine, ancitabine, anthramycin, arabinoside, azacitidine, azaserine, aziridines (e.g., benzodopa, carboquone, meturedopa, and uredopa), azauridine, bestrabucil, bisantrene, bisphosphonates (e.g. clodronate), bleomycins, bortezomib, bryostatin, cactinomycin, callystatin, carabicin, carminomycin, carmofur, carmustine, carzinophilin, CC-1065, chlorambucil, chloranbucil, chlornaphazine, chlorozotocin, chromomycinis, chromoprotein enediyne antibiotic chromophores, CPT-11, cryptophycins (e.g. cryptophycin 1 and cryptophycin 8), cyclophosphamide, cytarabine, dacarbazine, dactinomycin, daunomycin, defofamine, demecolcine, detorubicin, diaziquone, 6-diazo-5-oxo-L-norleucine, dideoxyuridine, difluoromethylornithine (DMFO), doxifluridine, doxorubicins (e.g., morpholinodoxorubicin, cyanomorpholino-doxorubicin, 2-pyrrolinodoxorubicin, and deoxydoxorubicin), dynemicins, edatraxate, edatrexate, eleutherobins, elformithine, elliptinium acetate, enediyne antibiotics (e.g. calicheamicins), eniluracil, enocitabine, epirubicins, epothilone, esorubicins, esperamicins, estramustine, ethylenimines, 2-ethylhydrazide, etoglucid, fludarabine, folic acid analogues (e.g., denopterin, methotrexate, pteropterin, and trimetrexate), folic acid replenishers (e.g. frolinic acid), fotemustine, fulvestrant, gacytosine, gallium nitrate, gefitinib, gemcitabine, hydroxyurea, ibandronate, ifosfamide, imatinib mesylate, erlotinib, fulvestrant, letrozole, PTK787/ZK 222584 (Novartis, Basel, CH), oxaliplatin, leucovorin, rapamycin, lapatinib, lonafarnib, sorafenib, methylamelamines (e.g., altretamine, triethy lenemelamine, triethy lenephosphoramide, triethylenethiophosphoramide and trimethylomelamine), pancratistatins, sarcodictyins, spongistatins, nitrogen mustards (e.g., chlorambucil, chlornaphazine, cyclophosphamide, mechlorethamine, mechlorethamine oxide hydrochloride, melphalan, novembichin, phenesterine, prednimustine, trofosfamide, and uracil mustard), nitrosureas (e.g., carmustine, fotemustine, lomustine, nimustine, and ranimnustine), dynemicins, neocarzinostatin chromophores, anthramycin, detorubicin, epirubicins, marcellomycins, mitomycins (e.g. mitomycin C), mycophenolic acid, nogalamycins, olivomycins, peplomycins, potfiromycins, puromycins, quelamycins, rodorubicins, ubenimex, zinostatins, zorubicins, purine analogs (e.g., fludarabine, 6-mercaptopurine, thiamiprine, and thioguanine), pyrimidine analogs (e.g., ancitabine, azacitidine, 6-azauridine, dideoxyuridine, doxifluridine, enocitabine, and floxuridine), aceglatone, lentinan, lonidainine, maytansinoids (e.g. maytansins and ansamitocins), mitoguazone, mitoxantrone, mopidanmol, nitraerine, pentostatin, phenamet, pirarubicin, podophyllinic acid, 2-ethylhydrazide, rhizoxin, sizofuran, spirogermanium, tenuazonic acid, triaziquone, 2,2',2"trichlorotriethylamine, trichothecenes (e.g., T-2 toxin, verracurin A, roridin A, and anguidine), urethan, vindesine, mannomustine, mitobronitol, mitolactol, pipobroman, arabinoside, cyclophosphamide, toxoids (e.g. paclitaxel and doxetaxel), 6-thioguanine, mercaptopurine, platinum, platinum analogs (e.g. cisplatin and carboplatin), etoposide (VP-16), mitoxantrone, vinorelbine, novantrone, daunomycin, xeloda, topoisomerase inhibitor RFS 2000, retinoids (e.g. retinoic acid), capecitabine, lomustine, losoxantrone, mercaptopurines, nimustine, nitraerine, rapamycin, razoxane, roridin A, spongistatins, streptonigrins, streptozocins, sutent, T-2 toxin, thiamiprine, thiotepa, toxoids (e.g. paclitaxel and doxetaxel), tubercidins, verracurin A, vinblastine, vincristine, and structural analogs of any of the aforementioned (e.g. synthetic analogs), and/or derivatives of any of the aforementioned (see e.g., Lindell T et al., *Science* 170: 447-9 (1970); Remillard S et al., *Science* 189: 1002-5 (1975); Ravry M et al., *Am J Clin Oncol* 8: 148-50 (1985); Ravry Metal., *Cancer Treat Rep* 69: 1457-8 (1985); Sternberg C et al., *Cancer* 64: 2448-58 (1989); Bai R et al., *Biochem Pharmacol* 39: 1941-9 (1990); Boger D, Johnson D, *Proc Natl Acad Sci USA* 92: 3642-9 (1995); Beck J et al., *Leuk Lymphoma* 41: 117-24 (2001); Cassady J et al., *Chem Pharm Bull* (Tokyo) 52: 1-26 (2004); Sapra P et al., *Clin Cancer Res* 11: 5257-64 (2005); Okeley N et al., *Clinc Cancer Res* 16: 888-97 (2010); Oroudjev E et al., *Mol Cancer Ther* 9: 2700-13 (2010); Ellestad G, *Chirality* 23: 660-71 (2011); Kantarjian H et al., *Lancet Oncol* 13: 403-11 (2012); Moldenhauer G et al., *J Natl Cancer Inst* 104: 622-34 (2012); Gromek S, Balunas M, *Curr Top Med Chem* 14: 2822-34 (2015); Meulendijks D et al., *Invest New Drugs* 34: 119-28 (2016)).

In certain embodiments of the cell-targeting molecules of the present invention, the additional exogenous material is a polypeptide characterized as highly efficient in delivering various molecules into cells, such polypeptides also known as "cell penetrating peptides" (CPPs) or "protein transduction domains" (PTDs) (see Futaki S et al., *Biochemistry* 41: 7925-30 (2002); Wender P et al., *J Am Chem Soc* 124: 13382-3 (2002); Dietz G, Bahr M, *Mol Cell Neurosci* 27: 85-131 (2004); Vives E, *J Control Release* 109: 77-85 (2005); Vivès E et al., *Biochim Biophys Acta* 17866: 126-38 (2008); van den Berg A, Dowdy S, *Curr Opin Biotechnol* 22: 888-93 (2011); Copolovici D et al., *ACS Nano* 8: 1972-94 (2014); Kauffman W et al., *Trends Biochem Sci* 40: 749-64 (2015); WO 2003106491; U.S. Pat. Nos. 7,579,318; 7,943,581; 8,242,081). In certain embodiments, the additional exogenous material comprises both a CPP and/or PTD and a nucleic acid and optionally a cationic peptide (see e.g. Lehto T et al., *Expert Opin Drug Deliv* 9: 823-36 (2012); Shukla R et al., *Mol Pharm* 11: 3395-408 (2014); Beloor J et al., *Ther Deliv* 6: 491-507 (2015); Chuah J et al., *Biomacromolecules* 10.1021/acs.biomac.6b01056 (2016); Cerrato C et al., *Expert Opin Drug Deliv* 1-11 (2016); Tai W, Gao X, *Adv Drug Deliv Rev* pii: 50169-409X: 30236-8 (2016); Wada S et al., *Bioorg Med Chem* 15: 4478-85 (2016)). In certain embodiments, the additional exogenous material comprises a CPP and/or PTD for intracellular targeting of another additional exogenous material (see e.g. Sakhrani N, Padh H, *Drug Des Devel Ther* 7: 585-99 (2013); Li H et al., *Int J Mol Sci* 16: 19518-36 (2015); Cerrato C et al., *Expert Opin Drug Deliv* 1-11 (2016)).

II. Examples of Structural Variants of the Cell-Targeting Molecules of the Present Invention In certain embodiments of the cell-targeting molecules of the present invention, many of the molecule's components have already been described, such as the binding region, linker, and/or toxin effector polypeptide (see e.g. WO 2005/092917, WO 2007/033497, US2009/0156417, JP4339511, EP1727827, DE602004027168, EP1945660, JP4934761, EP2228383, US2013/0196928, WO 2014/164680, WO 2014/164693, WO 2015/138435, WO 2015/138452, WO 2015/113005, WO 2015/113007, US20150259428, WO 2015/191764, WO 2016/126950).

The skilled worker will recognize that variations may be made to the Shiga toxin effector polypeptides and cell-targeting molecules of the present invention, and polynucleotides encoding any of the former, without diminishing their biological activities, e.g., by maintaining the overall structure and function of the Shiga toxin effector polypeptide, such as in conjunction with one or more 1) endogenous epitope disruptions which reduce antigenic and/or immunogenic potential, 2) furin-cleavage motif disruptions which reduce proteolytic cleavage, and/or 3) embedded or inserted epitopes which reduce antigenic and/or immunogenic potential and/or are capable of being delivered to a MEW I molecule for presentation on a cell surface. For example, some modifications may facilitate expression, facilitate purification, improve pharmacokinetic properties, and/or improve immunogenicity. Such modifications are well known to the skilled worker and include, for example, a methionine added at the amino-terminus to provide an initiation site, additional amino acids placed on either terminus to create conveniently located restriction sites or termination codons, and biochemical affinity tags fused to either terminus to provide for convenient detection and/or purification. A common modification to improve the immunogenicity of a polypeptide produced using a non-chordate system (e.g. a prokaryotic cell) is to remove, after the production of the polypeptide, the starting methionine residue, which may be formylated during production, such as, e.g., in a bacterial host system, because, e.g., the presence of N-formylmethionine (fMet) might induce undesirable immune responses in chordates.

Also contemplated herein is the inclusion of additional amino acid residues at the amino and/or carboxy termini of a Shiga toxin effector polypeptide of the present invention, a cell-targeting molecule of the present invention, or a proteinaceous component of a cell-targeting molecules of the present invention, such as sequences for epitope tags or other moieties. The additional amino acid residues may be used for various purposes including, e.g., facilitating cloning, facilitating expression, post-translational modification, facilitating synthesis, purification, facilitating detection, and administration. Non-limiting examples of epitope tags and moieties are chitin binding protein domains, enteropeptidase cleavage sites, Factor Xa cleavage sites, FIAsH tags, FLAG tags, green fluorescent proteins (GFP), glutathione-S-transferase moieties, HA tags, maltose binding protein domains, myc tags, polyhistidine tags, ReAsH tags, strep-tags, strep-tag II, TEV protease sites, thioredoxin domains, thrombin cleavage site, and V5 epitope tags.

In certain of the above embodiments, the polypeptide sequence of the Shiga toxin effector polypeptides and/or cell-targeting molecules of the present invention are varied by one or more conservative amino acid substitutions introduced into the polypeptide region(s) as long as all required structural features are still present and the Shiga toxin effector polypeptide is capable of exhibiting any required function(s), either alone or as a component of a cell-targeting molecule. As used herein, the term "conservative substitution" denotes that one or more amino acids are replaced by another, biologically similar amino acid residue. Examples include substitution of amino acid residues with similar characteristics, e.g. small amino acids, acidic amino acids, polar amino acids, basic amino acids, hydrophobic amino acids and aromatic amino acids (see, for example, Table B). An example of a conservative substitution with a residue normally not found in endogenous, mammalian peptides and proteins is the conservative substitution of an arginine or lysine residue with, for example, ornithine, canavanine, aminoethylcysteine, or another basic amino acid. For further information concerning phenotypically silent substitutions in peptides and proteins see, e.g., Bowie J et al., *Science* 247: 1306-10 (1990).

TABLE B

| Examples of Conservative Amino Acid Substitutions | | | | | | | | | | | | | |
|---|---|---|---|---|---|---|---|---|---|---|---|---|---|
| I | II | III | IV | V | VI | VII | VIII | IX | X | XI | XII | XIII | XIV |
| A | D | H | C | F | N | A | C | F | A | C | A | A | D |
| G | E | K | I | W | Q | G | M | H | C | D | C | C | E |
| P | Q | R | L | Y | S | I | P | W | F | E | D | D | G |
| S | N | | M | | T | L | | Y | G | H | G | E | K |
| T | | | V | | | V | | | H | K | N | G | P |
| | | | | | | | | | I | N | P | H | Q |
| | | | | | | | | | L | Q | S | K | R |
| | | | | | | | | | M | R | T | N | S |
| | | | | | | | | | R | S | V | Q | T |
| | | | | | | | | | T | T | | R | |
| | | | | | | | | | V | | | S | |
| | | | | | | | | | W | | | P | |
| | | | | | | | | | Y | | | T | |

In the conservative substitution scheme in Table B, exemplary conservative substitutions of amino acids are grouped by physicochemical properties—I: neutral, hydrophilic; II: acids and amides; III: basic; IV: hydrophobic; V: aromatic, bulky amino acids, VI hydrophilic uncharged, VII aliphatic uncharged, VIII non-polar uncharged, IX cycloalkenyl-associated, X hydrophobic, XI polar, XII small, XIII turn-permitting, and XIV flexible. For example, conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

Additional conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

In certain embodiments, the Shiga toxin effector polypeptides and cell-targeting molecules of the present invention may comprise functional fragments or variants of a polypeptide region of the present invention described herein that have, at most, 20, 15, 10, 9, 8, 7, 6, 5, 4, 3, 2, or 1 amino acid substitutions compared to a polypeptide sequence recited herein, as long as it (1) comprises at least one embedded or inserted, heterologous T-cell epitope and at least one amino acid is disrupted in an endogenous, B-cell and/or CD4+ T-cell epitope region provided in the Examples (see e.g. Tables 1-7 and/or 12), wherein the disrupted amino acid does not overlap with the embedded or inserted epitope; (2) comprises at least one embedded or inserted, heterologous T-cell epitope and a disrupted furin-cleavage motif at the carboxy-terminus of a Shiga toxin A1 fragment derived region; or (3) comprises a disrupted furin-cleavage motif at the carboxy-terminus of a Shiga toxin A1 fragment derived region and comprises at least one amino acid is disrupted in an endogenous, B-cell and/or CD4+ T-cell epitope region provided in the Examples (see e.g. Tables 1-7 and/or 12), wherein the disrupted amino acid does not overlap with the disrupted furin-cleavage motif. Variants of the Shiga toxin effector polypeptides and cell-targeting molecules of the invention are within the scope of the present invention as a result of changing a polypeptide described herein by altering one or more amino acid residues or deleting or inserting one or more amino acid residues, such as within the binding region or Shiga toxin effector polypeptide region, in order to achieve desired properties, such as changed cytotoxicity, changed cytostatic effects, changed immunogenicity, and/or changed serum half-life. The Shiga toxin effector polypeptides and cell-targeting molecules of the present invention may further be with or without a signal sequence.

Accordingly, in certain embodiments, the Shiga toxin effector polypeptides of the present invention comprise or consists essentially of amino acid sequences having at least 55%, 60%, 65%, 70%, 75%, 80%, 85%, 90%, 95%, 97%, 98%, or 99%, overall sequence identity to a naturally occurring Shiga toxin A Subunit or fragment thereof, such as, e.g., Shiga toxin A Subunit, such as SLT-1A (SEQ ID NO:1), StxA (SEQ ID NO:2), and/or SLT-2A (SEQ ID NO:3), wherein the Shiga toxin effector polypeptide (1) comprises at least one embedded or inserted, heterologous T-cell epitope and at least one amino acid is disrupted in an endogenous, B-cell and/or CD4+ T-cell epitope region provided in the Examples (see e.g. Tables 1-7 and/or 12), and wherein the disrupted amino acid does not overlap with the embedded or inserted epitope; (2) comprises at least one embedded or inserted, heterologous T-cell epitope and a disrupted furin-cleavage motif at the carboxy-terminus of a Shiga toxin A1 fragment derived region; or (3) comprises a disrupted furin-cleavage motif at the carboxy-terminus of a Shiga toxin A1 fragment derived region and comprises at least one amino acid is disrupted in an endogenous, B-cell and/or CD4+ T-cell epitope region provided in the Examples (see e.g. Tables 1-7 and/or 12), and wherein the disrupted amino acid does not overlap with the disrupted furin-cleavage motif.

In certain embodiments of the Shiga toxin effector polypeptides of the present invention, one or more amino acid residues may be mutated, inserted, or deleted in order to increase the enzymatic activity of the Shiga toxin effector polypeptide. In certain embodiments of the Shiga toxin effector polypeptides of the present invention, one or more amino acid residues may be mutated or deleted in order to reduce or eliminate catalytic and/or cytotoxic activity of the Shiga toxin effector polypeptide. For example, the catalytic and/or cytotoxic activity of the A Subunits of members of the Shiga toxin family may be diminished or eliminated by mutation or truncation.

The cytotoxicity of the A Subunits of members of the Shiga toxin family may be altered, reduced, or eliminated by mutation and/or truncation. The positions labeled tyrosine-77, glutamate-167, arginine-170, tyrosine-114, and tryptophan-203 have been shown to be important for the catalytic activity of Stx, Stx1, and Stx2 (Hovde C et al., *Proc Natl Acad Sci USA* 85: 2568-72 (1988); Deresiewicz R et al., *Biochemistry* 31: 3272-80 (1992); Deresiewicz R et al., *Mol Gen Genet* 241: 467-73 (1993); Ohmura M et al., *Microb Pathog* 15: 169-76 (1993); Cao C et al., *Microbiol Immunol* 38: 441-7 (1994); Suhan M, Hovde C, *Infect Immun* 66: 5252-9 (1998)). Mutating both glutamate-167 and arginine-170 eliminated the enzymatic activity of Slt-I A1 in a cell-free ribosome inactivation assay (LaPointe P et al., *J Biol Chem* 280: 23310-18 (2005)). In another approach using de novo expression of Slt-I A1 in the endoplasmic reticulum, mutating both glutamate-167 and arginine-170 eliminated Slt-I A1 fragment cytotoxicity at that expression level (LaPointe P et al., *J Biol Chem* 280: 23310-18 (2005)). A truncation analysis demonstrated that a fragment of StxA from residues 75 to 268 still retains significant enzymatic activity in vitro (Haddad J et al., *J Bacteriol* 175: 4970-8 (1993)). A truncated fragment of Slt-I A1 containing residues 1-239 displayed significant enzymatic activity in vitro and cytotoxicity by de novo expression in the cytosol (LaPointe Petal., *J Biol Chem* 280: 23310-18 (2005)). Expression of a Slt-I A1 fragment truncated to residues 1-239 in the endoplasmic reticulum was not cytotoxic because it could not retrotranslocate to the cytosol (LaPointe P et al., *J Biol Chem* 280: 23310-18 (2005)).

The most critical residues for enzymatic activity and/or cytotoxicity in the Shiga toxin A Subunits were mapped to the following residue-positions: asparagine-75, tyrosine-77, tyrosine-114, glutamate-167, arginine-170, arginine-176, and tryptophan-203 among others (Di R et al., *Toxicon* 57: 525-39 (2011)). In particular, a double-mutant construct of Stx2A containing glutamate-E167-to-lysine and arginine-176-to-lysine mutations was completely inactivated; whereas, many single mutations in Stx1 and Stx2 showed a 10-fold reduction in cytotoxicity. Further, truncation of Stx1A to 1-239 or 1-240 reduced its cytotoxicity, and similarly, truncation of Stx2A to a conserved hydrophobic residue reduced its cytotoxicity. The most critical residues for binding eukaryotic ribosomes and/or eukaryotic ribosome inhibition in the Shiga toxin A Subunit have been mapped to the following residue-positions arginine-172, arginine-176, arginine-179, arginine-188, tyrosine-189, valine-191, and leucine-233 among others (McCluskey A et al., *PLoS One* 7: e31191 (2012). However, certain modification may increase a Shiga toxin functional activity exhibited by a Shiga toxin effector polypeptide of the present invention. For example, mutating residue-position alanine-231 in Stx1A to glutamate increased Stx1A's enzymatic activity in vitro (Suhan M, Hovde C, *Infect Immun* 66: 5252-9 (1998)).

In certain embodiments of Shiga toxin effector polypeptides of the present invention derived from SLT-1A (SEQ ID NO:1) or StxA (SEQ ID NO:2), the one or more amino acid residues mutated include substitution of the asparagine at position 75, tyrosine at position 77, tyrosine at position 114, glutamate at position 167, arginine at position 170, arginine at position 176, and/or substitution of the tryptophan at position 203. Examples of such substitutions will be known to the skilled worker based on the prior art, such as asparagine at position 75 to alanine; tyrosine at position 77 to serine; substitution of the tyrosine at position 114 to serine; substitution of the glutamate position 167 to glutamate, glutamine, or lysine; substitution of the arginine at position 170 to alanine, glycine, or lysine; substitution of the arginine at position 176 to lysine; substitution of the tryptophan at position 203 to alanine; and/or substitution of the alanine at 231 with glutamate. Other mutations which either enhance or reduce Shiga toxin enzymatic activity and/or cytotoxicity are within the scope of the invention and may be determined using well-known techniques and assays disclosed herein.

In certain embodiments of the Shiga toxin effector polypeptide scaffolds of the present invention, the Shiga toxin effector polypeptide component of the scaffold is selected from any one of SEQ ID NOs: 233-756. In certain further embodiments of the Shiga toxin effector polypeptide scaffolds of the present invention, the Shiga toxin effector polypeptide component of the scaffold is selected from any one of SEQ ID NOs: 233-756 and the Shiga toxin effector polypeptide further comprises a linker. In certain further embodiments of the Shiga toxin effector polypeptide scaffolds of the present invention, the Shiga toxin effector polypeptide component of the scaffold is selected from any one of SEQ ID NOs: 233-756 and the Shiga toxin effector polypeptide scaffold further comprises a linker selected from any one of SEQ ID NOs: 757-761. In certain further embodiments of the Shiga toxin effector polypeptide scaffolds of the present invention, the Shiga toxin effector polypeptide component of the scaffold is selected from any one of SEQ ID NOs: 233-756 and the Shiga toxin effector polypeptide scaffold further comprises a linker selected from any one of SEQ ID NOs: 757-761 as long as there is a single, unique cysteine or lysine residue present in the scaffold outside of the Shiga toxin effector polypeptide. In certain further embodiments of the Shiga toxin effector polypeptide scaffolds of the present invention, the Shiga toxin effector polypeptide scaffold comprises or consists essentially of any one of SEQ ID NOs: 762-767.

In certain embodiments of the cell-targeting molecules of the present invention, the cell-targeting molecule comprises a Shiga toxin effector polypeptide component selected from any one of SEQ ID NOs: 5-756.

In certain embodiments of the cell-targeting molecules of the present invention, the cell-targeting molecule comprises a Shiga toxin effector polypeptide scaffold of the present invention. In certain further embodiments, the Shiga toxin effector polypeptide scaffold comprises only one cysteine and/or lysine residue. In certain further embodiments, the Shiga toxin effector polypeptide scaffold is selected from any one of SEQ ID NOs: 762-767.

In certain embodiments of the cell-targeting molecules of the present invention, the cell-targeting molecule comprises one or more of SEQ ID NOs: 757-761 and 768-772.

Certain embodiments of the cell-targeting molecules of the present invention comprise or consist essentially of any one of SEQ ID NOs: 773-829.

In certain embodiments of the cell-targeting molecules of the present invention, the cell-targeting molecule comprises a binding region comprising an immunoglobulin domain. In certain further embodiments of the cell-targeting molecule of the present invention, the binding region comprises a polypeptide(s) selected from the group consisting of: (a) a heavy chain variable ($V_H$) domain comprising a HCDR1 comprising or consisting essentially of the amino acid sequences as shown in any one of SEQ ID NOs: 844, 850, 857, 863, 869, 875, 881, 885, 891, 897, 903, 909, 915, 921, 927, 933, 939, 948, 954, 960, 966, 972, 978, 984, 990, 996, 1002, 1008, 1014, 1020, 1026, 1032, 1035, 1041, 1044, 1050, 1056, 1062, 1065, 1071, 1077, 1083, 1089, and 1095, a HCDR2 comprising or consisting essentially of the amino acid sequences as shown in SEQ ID NOs: 845, 851, 856, 858, 864, 876, 886, 892, 898, 904, 910, 916, 922, 928, 934, 940, 949, 955, 961, 967, 973, 979, 985, 991, 997, 1003, 1009, 1015, 1021, 1027, 1036, 1042, 1045, 1051, 1057, 1063, 1066, 1072, 1078, 1084, 1090, and 1096, and a HCDR3 comprising or consisting essentially of the amino acid sequences as shown in any one of SEQ ID NOs: 846, 852, 859, 865, 870, 872, 877, 882, 887, 893, 899, 905, 911, 917, 923, 929, 935, 941, 950, 956, 962, 968, 974, 980, 982, 986, 992, 998, 1004, 1010, 1016, 1022, 1028, 1037, 1043, 1046, 1064, 1052, 1058, 1067, 1073, 1079, 1085, 1091, and 1097; and (b) a light chain variable ($V_L$) domain comprising a LCDR1 comprising or consisting essentially of the amino acid sequences as shown in any one of SEQ ID NOs: 847, 853, 860, 866, 871, 888, 894, 900, 906, 912, 918, 924, 930, 936, 942, 947, 953, 959, 965, 971, 977, 983, 989, 995, 1001, 1007, 1013, 1019, 1025, 1032, 1038, 1047, 1053, 1059, 1068, 1074, 1080, 1086, 1092, and 1098, a LCDR2 comprising or consisting essentially of the amino acid sequences as shown in any one of SEQ ID NOs: 848, 854, 861, 867, 883, 889, 895, 901, 907, 913, 919, 925, 931, 937, 948, 954, 960, 966, 972, 978, 984, 990, 996, 1002, 1008, 1014, 1020, 1026, 1033, 1039, 1048, 1054, 1060, 1069, 1075, 1081, 1087, 1093, and 1099, and a LCDR3 comprising or consisting essentially of the amino acid sequences as shown in any one of SEQ ID NOs: 849, 855, 862, 868, 884, 890, 896, 902, 908, 914, 920, 926, 932, 938, 949, 955, 961, 967, 973, 979, 985, 991, 997, 1003, 1009, 1015, 1021, 1027, 1034, 1040, 1049, 1055, 1061, 1070, 1076, 1082, 1088, 1094, and 1100.

The Shiga toxin effector polypeptides, the Shiga toxin effector polypeptide scaffolds, and cell-targeting molecules of the present invention may optionally be conjugated to one or more additional agents, which may include therapeutic agents, diagnostic agents, and/or other additional exogenous materials known in the art, including such agents as described herein. In certain embodiments, the Shiga toxin effector polypeptide, the Shiga toxin effector polypeptide scaffold or cell-targeting molecule of the present invention is PEGylated or albuminated, such as, e.g., to provide de-immunization, disrupt furin-cleavage by masking the extended loop and/or the furin-cleavage motif at the carboxy-terminus of a Shiga toxin A1 fragment derived region, improve pharmacokinetic properties, and/or improve immunogenicity (see e.g., Wang Q et al., *Cancer Res* 53: 4588-94 (1993); Tsutsumi Y et al., *Proc Natl Acad Sci USA* 97: 8548-53 (2000); Buse J, El-Aneed A, *Nanomed* 5: 1237-60 (2010); Lim S et al., *J Control Release* 207-93 (2015)).

III. General Functions of the Cell-Targeting Molecules of the Present Invention

The molecules of the present invention are useful in a variety of applications involving cell-targeting molecules (see e.g. WO 2014/164680, WO 2014/164693, WO 2015/113005, WO 2015/113007, WO 2015/120058, WO 2015/138435, WO 2015/138452, US 2015/0259428, WO 2015/191764, US2016/177284, WO 2016/126950, WO 2016/196344, and WO 2017/019623). The Shiga toxin effector polypeptides, binding region polypeptides, and linkers of the present invention may be used as components to create cell-targeting molecules with improved properties (see e.g. WO 2014/164680, WO 2014/164693, WO 2015/113005, WO 2015/113007, WO 2015/120058, WO 2015/138435, WO 2015/138452, US 2015/0259428, WO 2015/191764, US2016/177284, WO 2016/126950, WO 2016/196344, and WO 2017/019623). The Shiga toxin effector polypeptides, binding region polypeptides, and linkers of the present invention are useful as components of various therapeutic and/or diagnostic molecules, such as, e.g. ligand-toxin fusions, immunotoxins, and/or immuno-conjugates (see e.g. WO 2015/113005, WO 2015/113007, WO 2015/138435, US 2015/0259428, WO 2015/191764, US2016/177284, WO 2016/126950, WO 2016/196344, and WO 2017/019623). The functional association of Shiga toxin effector polypeptides with cell-targeting binding regions enables the creation of cell-targeting molecules which selectively kill, inhibit the growth of, deliver exogenous material to, and/or detect specific cell types. For example, certain cell-targeting molecules of the present invention may be potently cytotoxic to target-expressing cells via their abilities to efficiently deliver into the interior of a target-expressing cell a catalytically active, Shiga toxin effector polypeptide(s) that is able to effectively route to the cytosol.

The Shiga toxin effector polypeptides and cell-targeting molecules of the present invention are useful in diverse applications involving, e.g., cell-killing; cell growth inhibition; intracellular, cargo delivery; biological information gathering; immune response stimulation, and/or remediation of a health condition. The cell-targeting molecules of the present invention are useful as therapeutic and/or diagnostic molecules, such as, e.g., as cell-targeting, cytotoxic, therapeutic molecules; cell-targeting, nontoxic, delivery vehicles; and/or cell-targeting, diagnostic molecules; for examples in applications involving the in vivo targeting of specific cell types for the diagnosis or treatment of a variety of diseases, including cancers, immune disorders, and microbial infections.

The Shiga toxin effector polypeptides of the present invention allow for controlled and site-specific conjugation of molecular cargos to form cell-targeting molecules capable of cell-targeted delivery of their cargo(s). For example, conjugation can be chemically limited to occur at a single amino acid residue or linker attached thereto in order to produce a homogeneous product with a defined conjugate stoichiometry using strategies such as engineered cysteine residues, unnatural amino acid residues, and/or enzymatic conjugation. Similarly, the cell-targeting molecules of the present invention allow for controlled and site-specific conjugation of heterologous molecules to form useful cell-targeting molecules conjugates, such as, e.g., conjugates involving therapeutic molecules, immunogenicity-reducing agents, half-life extending agents, and various other cargos.

The cell-targeting molecules of the present invention, and compositions thereof, have uses, e.g., for the selective delivery of cargos to target-expressing cells and as therapeutics for the treatment of a variety of diseases, disorders, and conditions, which include genetic disorders, genetic predispositions, infections, cancers, tumors, growth abnormalities, and/or immune disorders. Certain cell-targeting molecules of the present invention, and compositions thereof, may be used to selectively deliver conjugated cargo(s) to a target-expressing cell type(s) in the presence of one or more other cell types based on its cell-targeting and cellular internalization activity(ies), such as, e.g., a cargo having a desired, intracellular function. In addition, certain cell-targeting molecules of the present invention, and compositions thereof, may be used to selectively kill a target-expressing cell in the presence of one or more other cell types based on its cell-targeting activity and cellular internalization activity(ies), such as, e.g., by delivering into the interior of the targeted, target-expressing cell a component of the cell-targeting molecule which is cytotoxic at an intracellular location.

Depending on the embodiment, a Shiga toxin effector polypeptide or cell-targeting molecule of the present invention may have or provide one or more of the following characteristics or functionalities: (1) de-immunization (see e.g. WO 2015/113005; WO 2015/113007), (2) protease-cleavage resistance (see e.g. WO 2015/191764), (3) potent cytotoxicity at certain concentrations, (4) intracellular delivery of a cargo consisting of an additional material (e.g. a heterologous, T-cell epitope) (see e.g. WO 2015/113005), (4) selective cytotoxicity, (6) low off-target toxicity in multicellular organisms at certain doses or dosages (see e.g. WO 2015/191764), (7) delivery of a heterologous, T-cell epitope to the MHC class I presentation pathway of a target cell (see e.g. WO 2015/113005), and/or (8) stimulation of CD8+ T-cell immune response(s). Certain embodiments of the Shiga toxin effector polypeptides and cell-targeting molecules of the present invention are multi-functional because the molecules have two or more of the characteristics or functionalities described herein.

In certain embodiments, the cell-targeting molecules of the present invention are capable of binding extracellular target biomolecules associated with the cell surface of particular cell types and entering those cells. Once internalized within a targeted cell type, certain embodiments of the cell-targeting molecules of the invention are capable of routing an enzymatically active, cytotoxic, Shiga toxin effector polypeptide fragment into the cytosol of the target cell and eventually killing the cell. Alternatively, nontoxic or reduced-toxicity variants of the cell-targeting molecules of the present invention may be used to deliver additional exogenous materials into target cells, such as B-cell or T-cell epitopes, peptides, proteins, polynucleotides, and detection-promoting agents. This system is modular, in that any number of diverse binding regions can be used to target a Shiga toxin effector polypeptide of the present invention to various, diverse cell types.

A. Cell-Kill Via Shiga Toxin a Subunit Cytotoxicity

Certain embodiments of the Shiga toxin effector polypeptides and cell-targeting molecules of the present invention are cytotoxic. Certain further embodiments of the cell-targeting molecules of the present invention are cytotoxic only due to the presence of one or more Shiga toxin effector polypeptide components. The A Subunits of members of the Shiga toxin family each comprise an enzymatically active polypeptide region capable of killing a eukaryotic cell once in the cell's cytosol. Because members of the Shiga toxin family are adapted to killing eukaryotic cells, molecules derived from Shiga toxins, such as, e.g., molecules comprising certain embodiments of the Shiga toxin effector polypeptides of the present invention can exhibit potent cell-kill activities.

For certain embodiments of the cell-targeting molecules of the present invention, upon contacting a cell physically coupled with an extracellular target biomolecule of the binding region of the cell-targeting molecule (e.g. a target positive cell), the cell-targeting molecule is capable of causing death of the cell. For certain further embodiments, the $CD_{50}$ value of the cell-targeting molecule is less than 5, 2.5, 1, 0.5, or 0.25 nM, which is vastly more potent than an untargeted, wild-type, Shiga toxin effector polypeptide (e.g. SEQ ID NO:830).

Cell-kill may be accomplished using a molecule of the present invention under varied conditions of target cells, such as, e.g., an ex vivo manipulated target cell, a target cell cultured in vitro, a target cell within a tissue sample cultured in vitro, or a target cell in an in vivo setting like within a multicellular organism.

In certain embodiments, the Shiga toxin effector polypeptides and cell-targeting molecules of the present invention comprise (1) a de-immunized, Shiga toxin effector sub-region, (2) a protease-cleavage resistant region near the carboxy-terminus of a Shiga toxin A1 fragment derived region, (3) a carboxy-terminal, endoplasmic reticulum retention/retrieval signal motif; and/or (4) a heterologous, T-cell epitope embedded or inserted region; however, for certain further embodiments, these structural modifications do not significantly alter the potency of Shiga toxin cytotoxicity as compared to a reference molecules comprising a wild-type Shiga toxin A Subunit polypeptide, such as, e.g., a wild-type Shiga toxin A1 fragment. Thus, Shiga toxin effector polypeptides and cell-targeting molecules of the present invention which are de-immunized, protease cleavage resistant, and/or carrying embedded or inserted, heterologous, epitopes can maintain potent cytotoxicity while providing one or more various other functionalities or properties.

Already cytotoxic cell-targeting molecules comprising Shiga toxin effector polypeptides may be engineered by the skilled worker using the information and methods provided herein to be more cytotoxic and/or to have redundant, backup cytotoxicities operating via completely different mechanisms. These multiple cytotoxic mechanisms may complement each other by their diversity of functions (such as by providing potent killing via two mechanisms of cell-killing, direct and indirect, as well as mechanisms of immuno-stimulation to the local area), redundantly backup each other (such as by providing one cell-killing mechanism in the absence of the other mechanisms—like if a target cell is resistant to or acquires some immunity to a subset of previously active mechanisms), and/or protect against developed resistance (by limiting resistance to the less probable situation of the malignant or infected cell blocking multiple, different cell-killing mechanisms simultaneously).

B. Delivery of a T-Cell Epitope for MHC Class I Presentation on a Cell Surface

In certain embodiments, the Shiga toxin effector polypeptides and cell-targeting molecules of the present invention comprise a T-cell epitope, which enables the engineering of "T-cell epitope delivering" molecules with virtually unlimited choices of epitope-peptide cargos for delivery and cell-surface presentation by a nucleated, chordate cell. For certain embodiments, the Shiga toxin effector polypeptides and cell-targeting molecules of the present invention are each capable of delivering one or more T-cell epitopes, associated with the Shiga toxin effector polypeptides and/or cell-targeting molecules, to the proteasome of a cell. The delivered T-cell epitope are then proteolytic processed and presented by the MHC class I pathway on the surface of the cell. By conjugating MHC class I epitopes to cell-targeting molecules, the targeted delivery and presentation of immuno-stimulatory antigens may be accomplished in order to harness and direct a beneficial function(s) of a chordate immune system.

For certain embodiments, the Shiga toxin effector polypeptide or cell-targeting molecule of the present invention is capable of delivering a T-cell epitope to a MHC class I molecule of a cell for cell-surface presentation. In certain embodiments, the Shiga toxin effector polypeptide or cell-targeting molecule of the present invention comprises a heterologous, T-cell epitope, whether as an additional exogenous material or embedded or inserted within a Shiga toxin effector polypeptide. For certain further embodiments, the Shiga toxin effector polypeptide or cell-targeting molecule of the present invention is capable of delivering an embedded or inserted T-cell epitope to a MHC class I molecule for cell-surface presentation.

For certain embodiments, the Shiga toxin effector polypeptide of the present invention is capable of delivering a T-cell epitope, which is conjugated to the Shiga toxin effector polypeptide, to a MHC class I molecule of a cell in which the Shiga toxin effector polypeptide is present for presentation of the T-cell epitope by the MHC class I molecule on a surface of the cell. For certain further embodiments, the T-cell epitope is a heterologous, T-cell epitope. For certain further embodiments, the T-cell epitope functions as CD8+ T-cell epitope, whether already known or identified in the future using methods which are currently routine to the skilled worker.

For certain embodiments, the cell-targeting molecule of the present invention is capable of delivering a T-cell epitope, which is associated with the cell-targeting molecule, to a MHC class I molecule of a cell for presentation of the T-cell epitope by the MHC class I molecule on a surface of the cell. For certain further embodiments, the T-cell epitope is a heterologous, T-cell epitope which is conjugated to the Shiga toxin effector polypeptide. For certain further embodiments, the T-cell epitope functions as CD8+ T-cell epitope, whether already known or identified in the future using methods which are currently routine to the skilled worker.

For certain embodiments, upon contacting a cell with the cell-targeting molecule of the present invention, the cell-targeting molecule is capable of delivering a T-cell epitope-peptide, which is associated with the cell-targeting molecule, to a MHC class I molecule of the cell for presentation of the T-cell epitope-peptide by the MHC class I molecule on a surface of the cell. For certain further embodiments, the T-cell epitope-peptide is a heterologous epitope which is conjugated to a Shiga toxin effector polypeptide. For certain further embodiments, the T-cell epitope-peptide functions as CD8+ T-cell epitope, whether already known or identified in the future using methods which are currently routine to the skilled worker.

The addition of a heterologous epitope into or presence of a heterologous epitope in a cell-targeting molecule of the present invention, whether as an additional exogenous material or embedded or inserted within a Shiga toxin effector polypeptide, enables methods of using such cell-targeting molecules for the cell-targeted delivery of a chosen epitope for cell-surface presentation by a nucleated, target cell within a chordate.

One function of certain, CD8+ T-cell hyper-immunized, Shiga toxin effector polypeptides and cell-targeting molecules of the present invention is the delivery of one or more T-cell epitope-peptides to a MHC class I molecule for MHC class I presentation by a cell. Delivery of exogenous, T-cell epitope-peptides to the MHC class I system of a target cell can be used to induce the target cell to present the T-cell epitope-peptide in association with MHC class I molecules on the cell surface, which subsequently leads to the activation of CD8+ effector T-cells to attack the target cell.

The skilled worker, using techniques known in the art, can associate, couple, and/or link certain, Shiga toxin effector polypeptides of the present invention to various other cell-targeting binding regions to create cell-targeting molecules of the present invention which target specific, extracellular, target biomolecules physically coupled to cells and promote target-cell internalization of these cell-targeting molecules. All nucleated vertebrate cells are believed to be capable of presenting intracellular epitopes using the MHC class I system. Thus, extracellular target biomolecules of the cell-targeting molecules of the invention may in principle target any nucleated vertebrate cell for T-cell epitope delivery to a MHC class I presentation pathway of such a cell.

The epitope-delivering functions of the Shiga toxin effector polypeptides and cell-targeting molecules of the present invention can be detected and monitored by a variety of standard methods known in the art to the skilled worker and/or described herein (see e.g. WO 2015/113005).

Certain assays to monitor this function of the polypeptides and molecules of the present invention involve the direct detection of a specific MHC class I/peptide antigen complex in vitro or ex vivo. Common methods for direct visualization and quantitation of peptide-MHC class I complexes involve various immuno-detection reagents known to the skilled worker. For example, specific monoclonal antibodies can be developed to recognize a particular MHC/class I/peptide antigen complex. Similarly, soluble, multimeric T cell receptors, such as the TCR-STAR reagents (Altor Bioscience Corp., Mirmar, Fla., U.S.) can be used to directly visualize or quantitate specific MHC I/antigen complexes (Zhu X et al., *J Immunol* 176: 3223-32 (2006)). These specific mAbs or soluble, multimeric T-cell receptors may be used with various detection methods, including, e.g. immunohistochemistry, flow cytometry, and enzyme-linked immuno assay (ELISA).

An alternative method for direct identification and quantification of MHC I/peptide complexes involves mass spectrometry analyses, such as, e.g., the ProPresent Antigen Presentation Assay (ProImmune, Inc., Sarasota, Fla., U.S.) in which peptide-MCH class I complexes are extracted from the surfaces of cells, then the peptides are purified and identified by sequencing mass spectrometry (Falk K et al., *Nature* 351: 290-6 (1991)).

In certain assays to monitor the T-cell epitope delivery and MHC class I presentation function of the polypeptides and molecules of the present invention involve computational and/or experimental methods to monitor MHC class I and peptide binding and stability. Several software programs are available for use by the skilled worker for predicting the binding responses of peptides to MHC class I alleles, such as, e.g., The Immune Epitope Database and Analysis Resource (IEDB) Analysis Resource MHC-I binding prediction Consensus tool (Kim Y et al., *Nucleic Acid Res* 40: W525-30 (2012). Several experimental assays have been routinely applied, such as, e.g., cell surface binding assays and/or surface plasmon resonance assays to quantify and/or compare binding kinetics (Miles K et al., *Mol Immunol* 48: 728-32 (2011)). Additionally, other MHC-peptide binding assays based on a measure of the ability of a peptide to stabilize the ternary MHC-peptide complex for a given MHC class I allele, as a comparison to known controls, have been developed (e.g., MHC-peptide binding assay from ProImmmune, Inc.).

Alternatively, measurements of the consequence of MHC class I/peptide antigen complex presentation on the cell surface can be performed by monitoring the cytotoxic T-cell (CTL) response to the specific complex. These measurements by include direct labeling of the CTLs with MHC class I tetramer or pentamer reagents. Tetramers or pentamers bind directly to T cell receptors of a particular specificity, determined by the Major Histocompatibility Complex (MHC) allele and peptide complex. Additionally, the quantification of released cytokines, such as interferon gamma or interleukins by ELISA or enzyme-linked immunospot (ELIspot) is commonly assayed to identify specific CTL responses. The cytotoxic capacity of CTL can be measured using a number of assays, including the classical 51 Chromium (Cr) release assay or alternative non-radioactive cytotoxicity assays (e.g., CytoTox96® non-radioactive kits and CellTox™ CellTiter-GLO® kits available from Promega Corp., Madison, Wis., U.S.), Granzyme B ELISpot, Caspase Activity Assays or LAMP-1 translocation flow cytometric assays. To specifically monitor the killing of target cells, carboxyfluorescein diacetate succinimidyl ester (CF SE) can be used to easily and quickly label a cell population of interest for in vitro or in vivo investigation to monitor killing of epitope specific CSFE labeled target cells (Durward M et al., *J Vis Exp* 45 pii 2250 (2010)).

In vivo responses to MHC class I presentation can be followed by administering a WIC class I/antigen promoting agent (e.g., an immunogenic peptide, protein or inactivated/attenuated virus vaccine) followed by challenge with an active agent (e.g. a virus) and monitoring responses to that agent, typically in comparison with unvaccinated controls. Ex vivo samples can be monitored for CTL activity with methods similar to those described previously (e.g. CTL cytotoxicity assays and quantification of cytokine release).

HLA-A, HLA-B, and/or HLA-C molecules are isolated from the intoxicated cells after lysis using immune affinity (e.g., an anti-MHC antibody "pulldown" purification) and the associated peptides (i.e., the peptides presented by the isolated WIC molecules) are recovered from the purified complexes. The recovered peptides are analyzed by sequencing mass spectrometry. The mass spectrometry data is compared against a protein database library consisting of the sequence of the exogenous (non-self) peptide (T-cell epitope X) and the international protein index for humans (representing "self" or non-immunogenic peptides). The peptides are ranked by significance according to a probability database. All detected antigenic (non-self) peptide sequences are listed. The data is verified by searching against a scrambled decoy database to reduce false hits (see e.g. Ma B, Johnson R, *Mol Cell Proteomics* 11: 0111.014902 (2012)). The results will demonstrate that peptides from the T-cell epitope X are presented in MHC complexes on the surface of intoxicated target cells.

The set of presented peptide-antigen-WIC complexes can vary between cells due to the antigen-specific HLA molecules expressed. T-cells can then recognize specific peptide-antigen-MHC complexes displayed on a cell surface using different TCR molecules with different antigen-specificities.

Because multiple T-cell epitopes may be delivered by a cell-targeting molecule of the invention, such as, e.g., by embedding two or more different T-cell epitopes in a single proteasome delivering effector polypeptide, a single cell-targeting molecule of the invention may be effective chordates of the same species with different MHC class variants, such as, e.g., in humans with different HLA alleles. This may allow for the combining within a single molecule of different T-cell epitopes with different effectiveness in different sub-populations of subjects based on MHC complex protein diversity and polymorphisms. For example, human MHC complex proteins, HLA proteins, vary among humans based on genetic ancestry, e.g. African (sub-Saharan), Amerindian, Caucasiod, Mongoloid, New Guinean and Australian, or Pacific islander.

The applications involving the T-cell epitope delivering polypeptides and molecules of the present invention are vast. Every nucleated cell in a mammalian organism may be capable of MHC class I pathway presentation of immunogenic, T-cell epitope-peptides on their cell outer surfaces complexed to MHC class I molecules. In addition, the sensitivity of T-cell epitope recognition is so exquisite that only a few MHC-I peptide complexes are required to be presented to result in an immune response, e.g., even presentation of a single complex can be sufficient for recognition by an effector T-cell (Sykulev Y et al., *Immunity* 4: 565-71 (1996)).

The activation of T-cell responses are desired characteristics of certain anti-cancer, anti-neoplastic, anti-tumor, and/or anti-microbial biologic drugs to stimulate the patient's own immune system toward targeted cells. Activation of a robust and strong T-cell response is also a desired characteristic of many vaccines. The presentation of a T-cell epitope by a target cell within an organism can lead to the activation of robust immune responses to a target cell and/or its general locale within an organism. Thus, the targeted delivery of a T-cell epitope for presentation may be utilized for as a mechanism for activating T-cell responses during a therapeutic regime.

The presentation of a T-cell immunogenic epitope-peptide by the MHC class I system targets the presenting cell for killing by CTL-mediated lysis and also triggers immune stimulation in the local microenvironment. By engineering immunogenic epitope sequences within Shiga toxin effector polypeptide components of target-cell-internalizing therapeutic molecules, the targeted delivery and presentation of immuno-stimulatory antigens may be accomplished. The presentation of immuno-stimulatory non-self antigens, such as e.g. known viral antigens with high immunogenicity, by target cells signals to other immune cells to destroy the target cells as well as to recruit more immune cells to the area.

The presentation of an immunogenic, T-cell epitope-peptide by the MHC class I complex targets the presenting cell for killing by CTL-mediated cytolysis. The presentation by targeted cells of immuno-stimulatory non-self antigens, such as, e.g., known viral epitope-peptides with high immunogenicity, can signal to other immune cells to destroy the target cells and recruit more immune cells to the target cell site within a chordate.

Thus, already cytotoxic molecules, such as e.g. therapeutic or potentially therapeutic molecules comprising Shiga toxin effector polypeptides, may be engineered using methods of the present invention into more cytotoxic molecules and/or to have an additional cytotoxic mechanism operating via delivery of a T-cell epitope, presentation, and stimulation of effector T-cells. These multiple cytotoxic mechanisms may complement each other (such as by providing both direct target-cell-killing and indirect (CTL-mediated) cell-killing, redundantly backup each other (such as by providing one mechanism of cell-killing in the absence of the other), and/or protect against the development of therapeutic resistance (by limiting resistance to the less probable situation of the malignant or infected cell evolving to block two different cell-killing mechanisms simultaneously).

In addition, a cytotoxic molecule comprising a Shiga toxin effector polypeptide component that exhibits catalytic-based cytotoxicity may be engineered by the skilled worker using routine methods into enzymatically inactive variants. For example, the cytotoxic Shiga toxin effector polypeptide component of a cytotoxic molecule may be conferred with reduced activity and/or rendered inactive by the introduction of one or mutations and/or truncations such that the resulting molecule can still be cytotoxic via its ability to deliver a T-cell epitope to the MHC class I system of a target cell and subsequent presentation to the surface of the target cell. In another example, a T-cell epitope may be inserted or embedded into a Shiga toxin effector polypeptide such that the Shiga toxin effector polypeptide is inactivated by the added epitope (see e.g. WO 2015/113005). This approach removes one cytotoxic mechanism while retaining or adding another and may also provide a molecule capable of exhibiting immuno-stimulation to the local area of a target cell(s) within an organism via delivered T-cell epitope presentation or "antigen seeding." Furthermore, non-cytotoxic variants of the cell-targeting molecules of the present invention which comprise embedded or inserted, heterologous, T-cell epitopes may be useful in applications involving immune-stimulation within a chordate and/or labeling of target cells within a chordate with MHC class I molecule displayed epitopes.

The ability to deliver a T-cell epitope of certain Shiga toxin effector polypeptides and cell-targeting molecules of the present invention may be accomplished under varied conditions and in the presence of non-targeted bystander cells, such as, e.g., an ex vivo manipulated target cell, a target cell cultured in vitro, a target cell within a tissue sample cultured in vitro, or a target cell in an in vivo setting like within a multicellular organism.

C. Cell-Kill Via Targeted Cytotoxicity and/or Engagement of Cytotoxic T-Cells

For certain embodiments, the cell-targeting molecule of the present invention can provide 1) delivery of a T-cell epitope for MHC class I presentation by a target cell and/or 2) potent cytotoxicity. For certain embodiments of the cell-targeting molecules of the present invention, upon contacting a cell physically coupled with an extracellular target biomolecule of the cell-targeting binding region, the cell-targeting molecule of the invention is capable of causing death of the cell. The mechanism of cell-kill may be direct, e.g. via the enzymatic activity of a toxin effector polypeptide region, or indirect via CTL-mediated cytolysis.

1. Indirect Cell-Kill Via T-Cell Epitope Delivery and MHC Class I Presentation

Certain embodiments of the cell-targeting molecules of the present invention are cytotoxic because they comprise a CD8+ T-cell epitope capable of being delivered to the MHC class I presentation pathway of a target cell and presented on a cellular surface of the target cell. For example, T-cell epitope delivering, Shiga toxin effector polypeptides of the present invention, with or without endogenous epitope de-immunization, may be used as components of cell-targeting molecules for applications involving indirect cell-killing (see e.g. WO 2015/113005).

In certain embodiments of the cell-targeting molecules of the present invention, upon contacting a cell physically coupled with an extracellular target biomolecule of the cell-targeting binding region, the cell-targeting molecule of the invention is capable of indirectly causing the death of the cell, such as, e.g., via the presentation of one or more T-cell epitopes by the target cell and the subsequent recruitment of CTLs which kill the target cell.

The presentation of an antigenic peptide complexed with a MHC class I molecule by a cell sensitizes the presenting cell to targeted killing by cytotoxic T-cells (CTLs) via the induction of apoptosis, lysis, and/or necrosis. In addition, the CTLs which recognize the target cell may release immuno-stimulatory cytokines, such as, e.g., interferon gamma (IFN-gamma), tumor necrosis factor alpha (TNF), macrophage inflammatory protein-1 beta (MIP-1beta), and interleukins such as IL-17, IL-4, and IL-22. Furthermore, CTLs activated by recognition of a presented epitope may indiscriminately kill other cells proximal to the presenting cell regardless of the peptide-MHC class I complex repertoire presented by those proximal cells (Wiedemann A et al., *Proc Natl Acad Sci USA* 103: 10985-90 (2006)).

Because of MHC allele diversity within different species, a cell-targeting molecule of the present invention comprising only a single epitope may exhibit varied effectiveness to different patients or subjects of the same species. However, certain embodiments of the cell-targeting molecules of the present invention may each comprise multiple, T-cell epitopes that are capable of being delivered to the MHC class I system of a target cell simultaneously. Thus, for certain embodiments of the cell-targeting molecules of the present invention, a cell-targeting molecule is used to treat different subjects with considerable differences in their MHC molecules' epitope-peptide binding affinities (i.e. considerable differences in their MHC alleles and/or MHC genotypes). In addition, certain embodiments of the cell-targeting molecules of the present invention reduce or prevent target cell adaptations to escape killing (e.g. a target cancer cell mutating to escape therapeutic effectiveness or "mutant escape") by using multiple cell-killing mechanisms simultaneously (e.g. direct killing and indirect killing via multiple different T-cell epitopes simultaneously).

2. Direct Cell-Kill Via Cell-Targeted, Shiga Toxin Cytotoxicity

Certain embodiments of the cell-targeting molecules of the present invention are cytotoxic because they comprise a catalytically active, Shiga toxin effector polypeptide and regardless of the presence of any cytotoxic agent or immunogenic, CD8+ T-cell epitope in the molecule. For example, Shiga toxin effector polypeptides of the present invention, with or without endogenous epitope de-immunization, may be used as components of cell-targeting molecules for applications involving direct cell-killing, such as, e.g., via the ribotoxic, enzymatic activity of a Shiga toxin effector polypeptide or ribosome binding and interference with ribosome function due to a non-catalytic mechanism(s). For certain embodiments of the CD8+ T-cell hyper-immunized, cell-targeting molecules of the present invention, upon contacting a cell physically coupled with an extracellular target biomolecule of the cell-targeting binding region, the cell-targeting molecule of the invention is capable of directly causing the death of the cell, such as, e.g., without the involvement of an untargeted, cytotoxic T-cell (see Section III-D, supra).

D. Selective Cytotoxicity Among Cell Types

Certain cell-targeting molecules of the present invention have uses in the selective killing of specific target cells in the presence of untargeted, bystander cells. By targeting the delivery of Shiga toxin effector polypeptides of the present invention to specific cells via a cell-targeting binding region(s), the cell-targeting molecules of the present invention can exhibit cell-type specific, restricted cell-kill activities resulting in the exclusive or preferential killing selected cell types in the presence of untargeted cells. Similarly, by targeting the delivery of immunogenic T-cell epitopes to the MEW class I pathway of target cells, the subsequent presentation of T-cell epitopes and CTL-mediated cytolysis of target cells induced by the cell-targeting molecules of the invention can be restricted to exclusively or preferentially killing selected cell types in the presence of untargeted cells. In addition, both the cell-targeted delivery of a cytotoxic, Shiga toxin effector polypeptide region and an immunogenic, T-cell epitope can be accomplished by a single cell-targeting molecule of the present invention such that deliver of both potentially cytotoxic components is restricted exclusively or preferentially to target cells in the presence of untargeted cells.

For certain embodiments, the cell-targeting molecule of the present invention is cytotoxic at certain concentrations. In certain embodiments, upon administration of the cell-targeting molecule of the present invention to a mixture of cell types, the cytotoxic cell-targeting molecule is capable of selectively killing those cells which are physically coupled with an extracellular target biomolecule compared to cell types not physically coupled with an extracellular target biomolecule. For certain embodiments, the cytotoxic cell-targeting molecule of the present invention is capable of selectively or preferentially causing the death of a specific cell type within a mixture of two or more different cell types. This enables targeting cytotoxic activity to specific cell types with a high preferentiality, such as a 3-fold cytotoxic effect, over "bystander" cell types that do not express the target biomolecule. Alternatively, the expression of the target biomolecule of the binding region may be non-exclusive to one cell type if the target biomolecule is expressed in low enough amounts and/or physically coupled in low amounts with cell types that are not to be targeted. This enables the targeted cell-killing of specific cell types with a high preferentiality, such as a 3-fold cytotoxic effect, over "bystander" cell types that do not express significant amounts of the target biomolecule or are not physically coupled to significant amounts of the target biomolecule.

For certain further embodiments, upon administration of the cytotoxic cell-targeting molecule to two different populations of cell types, the cytotoxic cell-targeting molecule is capable of causing cell death as defined by the half-maximal cytotoxic concentration ($CD_{50}$) on a population of target cells, whose members express an extracellular target biomolecule of the binding region of the cytotoxic cell-targeting molecule, at a dose at least three-times lower than the $CD_{50}$ dose of the same cytotoxic cell-targeting molecule to a population of cells whose members do not express an extracellular target biomolecule of the binding region of the cytotoxic cell-targeting molecule.

For certain embodiments, the cytotoxic activity of a cell-targeting molecule of the present invention toward populations of cell types physically coupled with an extracellular target biomolecule is at least 3-fold higher than the cytotoxic activity toward populations of cell types not physically coupled with any extracellular target biomolecule of the binding region. According to the present invention, selective cytotoxicity may be quantified in terms of the ratio (a/b) of (a) cytotoxicity towards a population of cells of a specific cell type physically coupled with a target biomolecule of the binding region to (b) cytotoxicity towards a population of cells of a cell type not physically coupled with a target biomolecule of the binding region. In certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, or 1000-fold higher for populations of cells or cell types physically coupled with a target biomolecule of the binding region compared to populations of cells or cell types not physically coupled with a target biomolecule of the binding region.

For certain embodiments, the preferential cell-killing function or selective cytotoxicity of a cell-targeting molecule of the present invention is due to an additional exogenous material (e.g. a cytotoxic material) and/or heterologous, T-cell epitope present in a Shiga toxin effector polypeptide of the present invention and not necessarily a result of the catalytic activity of a Shiga toxin effector polypeptide.

This preferential cell-killing function allows a targeted cell to be killed by certain cytotoxic, cell-targeting molecules of the present invention under varied conditions and in the presence of non-targeted bystander cells, such as ex vivo manipulated mixtures of cell types, in vitro cultured tissues with mixtures of cell types, or in vivo in the presence of multiple cell types (e.g. in situ or in a native location within a multicellular organism).

E. Delivery of Molecular Cargos into Interior Compartments of Target Cells

In addition to cytotoxic, cytostatic, and immune stimulation applications, cell-targeting molecules of the present invention optionally may be used for targeted intracellular delivery functions, such as, e.g., in applications involving information gathering and diagnostic functions.

Because the cell-targeting molecules of the invention, including reduced cytotoxicity and/or nontoxic forms thereof, are capable of entering cells physically coupled with an extracellular target biomolecule recognized by the cell-targeting molecule's binding region, certain embodiments of the cell-targeting molecules of the invention may be used to deliver additional exogenous materials or "cargos" (e.g. conjugated molecules) into the interior of targeted cell types. For example, non-toxic variants of the cytotoxic, cell-targeting molecules of the invention, or optionally cytotoxic variants, may be used to deliver additional exogenous materials to and/or label the interiors of cells physically coupled with an extracellular target biomolecule of the binding region of the cell-targeting molecule. Various types of cells and/or cell populations which express target biomolecules to at least one cellular surface may be targeted by the cell-targeting molecules of the invention for receiving exogenous materials. The functional components of the present invention are modular, in that various Shiga toxin effector polypeptides, additional exogenous materials, and binding regions may be associated with each other to provide cell-targeting molecules suitable for diverse applications involving cargo delivery, such as, e.g., non-invasive, in vivo imaging of tumor cells.

This delivery of exogenous material function of certain cell-targeting molecules of the present invention may be accomplished under varied conditions and in the presence of non-targeted bystander cells, such as, e.g., an ex vivo manipulated target cell, a target cell cultured in vitro, a target cell within a tissue sample cultured in vitro, or a target cell in an in vivo setting like within a multicellular organism. Furthermore, the selective delivery of exogenous material to certain cells by certain cell-targeting molecules of the present invention may be accomplished under varied conditions and in the presence of non-targeted bystander cells, such as ex vivo manipulated mixtures of cell types, in vitro cultured tissues with mixtures of cell types, or in vivo in the presence of multiple cell types (e.g. in situ or in a native location within a multicellular organism).

Shiga toxin effector polypeptides and cell-targeting molecules which are not capable, such as a certain concentration ranges, of killing a target cell and/or delivering an embedded or inserted epitope for cell-surface presentation by a WIC molecule of a target cell may still be useful for delivering exogenous materials into cells, such as, e.g., detection-promoting agents.

For certain embodiments, the Shiga toxin effector polypeptides of the present invention exhibits low to zero cytotoxicity and thus are referred to herein as "noncytotoxic and/or reduced cytotoxic." For certain embodiments, the cell-targeting molecule of the present invention exhibits low to zero cytotoxicity and may be referred to as "noncytotoxic" and/or "reduced cytotoxic variants." For example, certain embodiments of the molecules of the present invention do not exhibit a significant level of Shiga toxin based cytotoxicity wherein at doses of less than 1,000 nM, 500 nM, 100 nM, 75 nM, 50 nM, there is no significant amount of cell death as compared to the appropriate reference molecule, such as, e.g., as measured by an assay known to the skilled worker and/or described herein. For certain further embodiments, the molecules of the present invention do not exhibit any toxicity at dosages of 1-100 microgram (μg) per kilogram (kg) of a mammalian recipient. Reduced-cytotoxic variants may still be cytotoxic at certain concentrations or dosages but exhibit reduced cytotoxicity, such as, e.g., are not capable of exhibiting a significant level of Shiga toxin cytotoxicity in certain situations.

Shiga toxin effector polypeptides of the present invention, and certain cell-targeting molecules comprising the same, can be rendered non-cytotoxic, such as, e.g., via the addition of one or more amino acid substitutions known to the skilled worker to inactivate a Shiga toxin A Subunit and/or Shiga toxin effector polypeptide, including exemplary substitutions described herein. The non-cytotoxic and reduced cytotoxic variants of the cell-targeting molecules of the present invention may be in certain situations more suitable for delivery of additional exogenous materials than more cytotoxic variants.

F. Information Gathering for Diagnostic Functions

Certain cell-targeting molecules of the present invention have uses in the in vitro and/or in vivo detection of specific cells, cell types, and/or cell populations, as well as specific subcellular compartments of any of the aforementioned. Reduced-cytotoxicity and/or nontoxic forms of the cytotoxic, cell-targeting molecules of the invention that are conjugated to detection-promoting agents optionally may be used for diagnostic functions, such as for companion diagnostics used in conjunction with a therapeutic regimen comprising the same or a related binding region, such as, e.g., a binding region with high-affinity binding to the same target biomolecule, an overlapping epitope, and/or the same epitope.

In certain embodiments, the cell-targeting molecules described herein are used for both diagnosis and treatment, or for diagnosis alone. When the same cytotoxic cell-targeting molecule is used for both diagnosis and treatment, for certain embodiments of the present invention the cell-targeting molecule variant which incorporates a detection-promoting agent for diagnosis may have its cytotoxicity reduced or may be rendered nontoxic by catalytic inactivation of its Shiga toxin effector polypeptide region(s) via one or more amino acid substitutions, including exemplary substitutions described herein. For example, certain nontoxic variants of the cell-targeting molecules of the present invention exhibit less than 5%, 4%, 3%, 2%, or 1% death of target cells after administration of a dose less than 1 mg/kg. Reduced-cytotoxicity variants may still be cytotoxic at certain concentrations or dosages but exhibit reduced cytotoxicity, such as, e.g., are not capable of exhibiting a significant level of Shiga toxin cytotoxicity as described herein.

The ability to conjugate detection-promoting agents known in the art to various cell-targeting molecules of the present invention provides useful compositions for the detection of certain cells, such as, e.g., cancer, tumor, immune, and/or infected cells. These diagnostic embodiments of the cell-targeting molecules of the invention may be used for information gathering via various imaging techniques and assays known in the art. For example, diagnostic embodiments of the cell-targeting molecules of the invention may be used for information gathering via imaging of intracellular organelles (e.g. endocytotic, Golgi, endoplasmic reticulum, and cytosolic compartments) of individual cancer cells, immune cells, and/or infected cells in a patient or biopsy sample.

Various types of information may be gathered using the diagnostic embodiments of the cell-targeting molecules of the invention whether for diagnostic uses or other uses. This information may be useful, for example, in diagnosing neoplastic cell types, determining therapeutic susceptibilities of a patient's disease, assaying the progression of anti-neoplastic therapies over time, assaying the progression of immunomodulatory therapies over time, assaying the progression of antimicrobial therapies over time, evaluating the presence of infected cells in transplantation materials, evaluating the presence of unwanted cell types in transplantation materials, and/or evaluating the presence of residual tumor cells after surgical excision of a tumor mass.

For example, subpopulations of patients might be ascertained using information gathered using the diagnostic variants of the cell-targeting molecules of the invention, and then individual patients could be further categorized into subpopulations based on their unique characteristic(s) revealed using those diagnostic embodiments. For example, the effectiveness of specific pharmaceuticals or therapies might be a criterion used to define a patient subpopulation. For example, a nontoxic diagnostic variant of a particular cytotoxic, cell-targeting molecule of the invention may be used to differentiate which patients are in a class or subpopulation of patients predicted to respond positively to a cytotoxic variant of that cell-targeting molecule of the invention. Accordingly, associated methods for patient identification, patient stratification, and diagnosis using cell-targeting molecules of the present invention, including non-toxic variants of cytotoxic, cell-targeting molecules of the present invention, are considered to be within the scope of the present invention.

The expression of the target biomolecule by a cell need not be native in order for cell-targeting by a cell-targeting molecule of the present invention, such as, e.g., for direct cell-kill, indirect cell-kill, delivery of exogenous materials like T-cell epitopes, and/or information gathering. Cell surface expression of the target biomolecule could be the result of an infection, the presence of a pathogen, and/or the presence of an intracellular microbial pathogen. Expression of a target biomolecule could be artificial such as, for example, by forced or induced expression after infection with a viral expression vector, see e.g. adenoviral, adeno-associated viral, and retroviral systems. An example of inducing expression of a target biomolecule is the upregulation of CD38 expression of cells exposed to retinoids, like all-trans retinoic acid and various synthetic retinoids, or any retinoic acid receptor (RAR) agonist (Drach J et al., *Cancer Res* 54: 1746-52 (1994); Uruno A et al., *J Leukoc Biol* 90: 235-47 (2011)). Expression of CD30 can be induced in both B-cells and T-cells by exposure to by mitogens, phytohemagglutinin (PHA), staphylococcal protein A, EBV virus, human T-cell leukemia virus 1 or 2 (HTLV-1 or HTLV-2) (see e.g. Stein H et al., *Blood* 66: 848-58 (1985)). In another example, CD20, HER2, and EGFR expression may be induced by exposing a cell to ionizing radiation (Wattenberg M et al., *Br J Cancer* 110: 1472-80 (2014)). Further, PSMA expression is upregulated in response to androgen deprivation (see e.g. Chang S et al., *Cancer* 88: 407-15 (2000); Meller B et al., *EJNMMI Res* 5: 66 (2015)).

In certain embodiments, the molecule of the present invention is useful for tracking the behavior of an inert Shiga toxin effector polypeptide and/or cell-targeting molecule, such as, e.g., in vivo, tissue culture, and/or by a laboratory sensor. For example, a dye-conjugated Shiga toxin effector polypeptide of the present invention may be tracked using a light sensor during an experiment, e.g., both before and after an anti-Shiga toxin antibody incubation step.

IV. Pharmaceutical and Diagnostic Compositions Comprising Cell-Targeting Molecules of the Present Invention The present invention provides Shiga toxin effector polypeptides and cell-targeting molecules for use, alone or in combination with one or more additional therapeutic agents, in a pharmaceutical composition, for treatment or prophylaxis of conditions, diseases, disorders, or symptoms described in further detail below (e.g. cancers, malignant tumors, non-malignant tumors, growth abnormalities, immune disorders, and microbial infections). The present invention further provides pharmaceutical compositions comprising a Shiga toxin polypeptide or cell-targeting molecule of the present invention, or a pharmaceutically acceptable salt or solvate thereof, according to the invention, together with at least one pharmaceutically acceptable carrier, excipient, or vehicle. In certain embodiments, the pharmaceutical composition of the present invention may comprise homo-multimeric and/or hetero-multimeric forms of a Shiga toxin effector polypeptides or cell-targeting molecule of the present invention. The pharmaceutical compositions of the invention are useful in methods of treating, ameliorating, or preventing a disease, condition, disorder, or symptom described in further detail below. Each such disease, condition, disorder, or symptom is envisioned to be a separate embodiment with respect to uses of a pharmaceutical composition according to the invention. The invention further provides pharmaceutical compositions for use in at least one method of treatment according to the invention, as described in more detail below.

As used herein, the terms "patient" and "subject" are used interchangeably to refer to any organism, commonly vertebrates such as humans and animals, which presents symptoms, signs, and/or indications of at least one disease, disorder, or condition. These terms include mammals such as the non-limiting examples of primates, livestock animals (e.g. cattle, horses, pigs, sheep, goats, etc.), companion animals (e.g. cats, dogs, etc.) and laboratory animals (e.g. mice, rabbits, rats, etc.).

As used herein, "treat," "treating," or "treatment" and grammatical variants thereof refer to an approach for obtaining beneficial or desired clinical results. The terms may refer to slowing the onset or rate of development of a condition, disorder or disease, reducing or alleviating symptoms associated with it, generating a complete or partial regression of the condition, or some combination of any of the above. For the purposes of this invention, beneficial or desired clinical results include, but are not limited to, reduction or alleviation of symptoms, diminishment of extent of disease, stabilization (e.g. not worsening) of state of disease, delay or slowing of disease progression, amelioration or palliation of the disease state, and remission (whether partial or total), whether detectable or undetectable. "Treat," "treating," or "treatment" can also mean prolonging survival relative to expected survival time if not receiving treatment. A subject (e.g. a human) in need of treatment may thus be a subject already afflicted with the disease or disorder in question. The terms "treat," "treating," or "treatment" includes inhibition or reduction of an increase in severity of a pathological state or symptoms relative to the absence of treatment, and is not necessarily meant to imply complete cessation of the relevant disease, disorder, or condition. With regard to tumors and/or cancers, treatment includes reduction in overall tumor burden and/or individual tumor size.

As used herein, the terms "prevent," "preventing," "prevention" and grammatical variants thereof refer to an approach for preventing the development of, or altering the pathology of, a condition, disease, or disorder. Accordingly, "prevention" may refer to prophylactic or preventive measures. For the purposes of this invention, beneficial or desired clinical results include, but are not limited to, prevention or slowing of symptoms, progression or development of a disease, whether detectable or undetectable. A subject (e.g. a human) in need of prevention may thus be a subject not yet afflicted with the disease or disorder in question. The term "prevention" includes slowing the onset of disease relative to the absence of treatment, and is not necessarily meant to imply permanent prevention of the relevant disease, disorder or condition. Thus "preventing" or "prevention" of a condition may in certain contexts refer to reducing the risk of developing the condition, or preventing or delaying the development of symptoms associated with the condition.

As used herein, an "effective amount" or "therapeutically effective amount" is an amount or dose of a composition (e.g. a therapeutic composition, compound, or agent) that produces at least one desired therapeutic effect in a subject, such as preventing or treating a target condition or beneficially alleviating a symptom associated with the condition. The most desirable therapeutically effective amount is an amount that will produce a desired efficacy of a particular treatment selected by one of skill in the art for a given subject in need thereof. This amount will vary depending upon a variety of factors understood by the skilled worker, including but not limited to the characteristics of the therapeutic composition (including activity, pharmacokinetics, pharmacodynamics, and bioavailability), the physiological condition of the subject (including age, sex, disease type, disease stage, general physical condition, responsiveness to a given dosage, and type of medication), the nature of the pharmaceutically acceptable carrier or carriers in the formulation, and the route of administration. One skilled in the clinical and pharmacological arts will be able to determine a therapeutically effective amount through routine experimentation, namely by monitoring a subject's response to administration of a composition and adjusting the dosage accordingly (see e.g. *Remington: The Science and Practice of Pharmacy* (Gennaro A, ed., Mack Publishing Co., Easton, Pa., U.S., 19th ed., 1995)).

Diagnostic compositions of the present invention comprise a cell-targeting molecule of the present invention and one or more detection-promoting agents. When producing or manufacturing a diagnostic composition of the present invention, a cell-targeting molecule of the present invention may be directly or indirectly linked to one or more detection-promoting agents. There are numerous standard techniques known to the skilled worker for incorporating, affixing, and/or conjugating various detection-promoting agents to proteins or proteinaceous components of molecules, especially to immunoglobulins and immunoglobulin-derived domains.

There are numerous detection-promoting agents known to the skilled worker, such as isotopes, dyes, colorimetric agents, contrast enhancing agents, fluorescent agents, bioluminescent agents, and magnetic agents, which can be operably linked to the polypeptides or cell-targeting molecules of the invention for information gathering methods, such as for diagnostic and/or prognostic applications to diseases, disorders, or conditions of an organism (see e.g.

Cai W et al., *Nucl Med* 48: 304-10 (2007); Nayak T, Brechbiel M, *Bioconjug Chem* 20: 825-41 (2009); Paudyal P et al., *Oncol Rep* 22: 115-9 (2009); Qiao J et al., *PLoS ONE* 6: e18103 (2011); Sano K et al., *Breast Cancer Res* 14: R61 (2012)). These agents may be associated with, linked to, and/or incorporated within the polypeptide or cell-targeting molecule of the invention at any suitable position. For example, the linkage or incorporation of the detection-promoting agent may be via an amino acid residue(s) of a molecule of the present invention or via some type of linkage known in the art, including via linkers and/or chelators. The incorporation of the agent is in such a way to enable the detection of the presence of the diagnostic composition in a screen, assay, diagnostic procedure, and/or imaging technique.

Similarly, there are numerous imaging approaches known to the skilled worker, such as non-invasive in vivo imaging techniques commonly used in the medical arena, for example: computed tomography imaging (CT scanning), optical imaging (including direct, fluorescent, and bioluminescent imaging), magnetic resonance imaging (MRI), positron emission tomography (PET), single-photon emission computed tomography (SPECT), ultrasound, and x-ray computed tomography imaging.

V. Molecules of the Present Invention Immobilized on Solid Substrates

Certain embodiments of the present invention include a molecule of the present invention (e.g. a Shiga toxin effector polypeptide, a Shiga toxin effector polypeptide scaffold, a cell-targeting molecule, fusion protein, or polynucleotide of the present invention), or any effector fragment thereof, immobilized on a solid substrate. Solid substrates contemplated herein include, but are not limited to, microbeads, nanoparticles, polymers, matrix materials, microarrays, microtiter plates, or any solid surface known in the art (see e.g. U.S. Pat. No. 7,771,955). In accordance with these embodiments, a molecule of the present invention may be covalently or non-covalently linked to a solid substrate, such as, e.g., a bead, particle, or plate, using techniques known to the skilled worker (see e.g. Jung Y et al., *Analyst* 133: 697-701 (2008)). Immobilized molecules of the invention may be used for screening applications using techniques known in the art (see e.g. Bradbury A et al., *Nat Biotechnol* 29: 245-54 (2011); Sutton C, *Br J Pharmacol* 166: 457-75 (2012); Diamante L et al., *Protein Eng Des Sel* 26: 713-24 (2013); Houlihan G et al., *J Immunol Methods* 405: 47-56 (2014)).

Non-limiting examples of solid substrates to which a molecule of the invention may be immobilized on include: microbeads, nanoparticles, polymers, nanopolymers, nanotubes, magnetic beads, paramagnetic beads, superparamagnetic beads, streptavidin coated beads, reverse-phase magnetic beads, carboxy terminated beads, hydrazine terminated beads, silica (sodium silica) beads and iminodiacetic acid (IDA)-modified beads, aldehyde-modified beads, epoxy-activated beads, diaminodipropylamine (DADPA)-modified beads (beads with primary amine surface group), biodegradable polymeric beads, polystyrene substrates, amino-polystyrene particles, carboxyl-polystyrene particles, epoxy-polystyrene particles, dimethylamino-polystyrene particles, hydroxy-polystyrene particles, colored particles, flow cytometry particles, sulfonate-polystyrene particles, nitrocellulose surfaces, reinforced nitrocellulose membranes, nylon membranes, glass surfaces, activated glass surfaces, activated quartz surfaces, polyvinylidene difluoride (PVDF) membranes, polyacrylamide-based substrates, poly-vinyl chloride substrates, poly-methyl methacrylate substrates, poly(dimethyl siloxane) substrates, and photopolymers which contain photoreactive species (such as nitrenes, carbenes, and ketyl radicals) capable of forming covalent linkages. Other examples of solid substrates to which a molecule of the invention may be immobilized on are commonly used in molecular display systems, such as, e.g., cellular surfaces, phages, and virus particles.

VI. Production or Manufacture of Pharmaceutical and/or Diagnostic Compositions Comprising Cell-Targeting Molecules of the Present Invention Pharmaceutically acceptable salts or solvates of any of the Shiga toxin effector polypeptides, Shiga toxin effector polypeptide scaffolds, and cell-targeting molecules of the present invention are within the scope of the present invention. In addition, pharmaceutical compositions comprising a salt or solvate of a cell-targeting molecule(s) of the present invention are within the scope of the present invention.

The term "solvate" in the context of the present invention refers to a complex of defined stoichiometry formed between a solute (in casu, a proteinaceous compound or pharmaceutically acceptable salt thereof according to the invention) and a solvent. The solvent in this connection may, for example, be water, ethanol or another pharmaceutically acceptable, typically small-molecular organic species, such as, but not limited to, acetic acid or lactic acid. When the solvent in question is water, such a solvate is normally referred to as a hydrate.

Polypeptides and proteins of the present invention, or salts thereof, may be formulated as pharmaceutical compositions prepared for storage or administration, which typically comprise a therapeutically effective amount of a molecule of the present invention, or a salt thereof, in a pharmaceutically acceptable carrier. The term "pharmaceutically acceptable carrier" includes any of the standard pharmaceutical carriers. Pharmaceutically acceptable carriers for therapeutic molecule use are well known in the pharmaceutical art, and are described, for example, in *Remington's Pharmaceutical Sciences* (Mack Publishing Co. (A. Gennaro, ed., 1985). As used herein, "pharmaceutically acceptable carrier" includes any and all physiologically acceptable, i.e. compatible, solvents, dispersion media, coatings, antimicrobial agents, isotonic, and absorption delaying agents, and the like. Pharmaceutically acceptable carriers or diluents include those used in formulations suitable for oral, rectal, nasal or parenteral (including subcutaneous, intramuscular, intravenous, intradermal, and transdermal) administration. Exemplary pharmaceutically acceptable carriers include sterile aqueous solutions or dispersions and sterile powders for the extemporaneous preparation of sterile injectable solutions or dispersions. Examples of suitable aqueous and nonaqueous carriers that may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyloleate. Proper fluidity can be maintained, for example, by the use of coating materials, such as lecithin, by the maintenance of the required particle size in the case of dispersions, and by the use of surfactants. In certain embodiments, the carrier is suitable for intravenous, intramuscular, subcutaneous, parenteral, spinal or epidermal administration (e.g. by injection or infusion). Depending on selected route of administration, the protein or other pharmaceutical component may be coated in a material intended to protect the compound from the action of low pH and other natural inactivating conditions to which the active protein may encounter when administered to a patient by a particular route of administration.

Therapeutic compositions of the present invention are typically sterile and stable under the conditions of manufacture and storage. The composition may be formulated as a solution, solvate, salt, powder, microemulsion, liposome, or other ordered structure suitable to high drug concentration. The carrier may be a solvent or dispersion medium containing, for example, water, alcohol such as ethanol, polyol (e.g., glycerol, propylene glycol, and liquid polyethylene glycol), or any suitable mixture. The proper fluidity may be maintained, for example, by the use of a coating such as lecithin, by the maintenance of the required particle size in the case of dispersion and by use of surfactants according to formulation chemistry well known in the art. In certain embodiments, the pharmaceutical composition of the present invention may comprise one or more isotonic agents, such as, e.g., a sugar, polyalcohol, and/or ions like mannitol, sorbitol, and sodium chloride A pharmaceutical composition of the present invention optionally includes a pharmaceutically acceptable excipient. Non-limiting examples of pharmaceutically acceptable excipients include arginine, arginine sulfate, glycerol, mannitol, methionine, polysorbate, sodium chloride, sorbitol, sucrose, and/or trehalose. In certain embodiments, the pharmaceutical composition of the present invention comprises an aqueous carrier and at least one pharmaceutically acceptable excipient. In certain other embodiments, the pharmaceutical composition of the present invention comprises a salt and/or powder, such as, e.g. a freeze-dried, lyophilized, dehydrated, and/or cryodessicated composition comprising at least one pharmaceutically acceptable excipient. In certain embodiments of the pharmaceutical composition of the present invention, the excipient functions to reduce and/or limit the immunogenicity and/or immunogenic potential of the cell-targeting molecule, such as, e.g. after administration and/or repeated administration to a mammal.

The pharmaceutical compositions of the present invention may comprise one or more adjuvants such as a buffer, tonicity-adjusting agent (isotonic agent), antioxidant, surfactant, stabilizer, preservative, emulsifying agent, cryoprotective agent, wetting agent, and/or dispersing agent or other additives well known to those of skill in the art, such as, e.g. a binding agent. In certain embodiments, the pharmaceutical composition of the present invention comprises an aqueous carrier and a pharmaceutically acceptable adjuvant or other additive. In certain other embodiments, the pharmaceutical composition of the present invention comprises a salt and/or powder, such as, e.g. a freeze-dried, lyophilized, dehydrated, and/or cryodessicated composition comprising a pharmaceutically acceptable adjuvant or other additive. A non-limiting example of a pharmaceutically suitable stabilizer is human albumin.

The pharmaceutical composition of the present invention may comprise one or more pharmaceutically acceptable buffers. Non-limiting examples of suitable buffers include acetate, citrate, histidine, phosphate, and succinate buffers. In certain embodiments, the pharmaceutical composition of the present invention comprises an aqueous carrier comprising a pharmaceutically acceptable buffer. In certain other embodiments, the pharmaceutical composition of the present invention comprises a salt and/or powder, such as, e.g. a freeze-dried, lyophilized, dehydrated, and/or cryodessicated composition comprising a pharmaceutically acceptable buffer.

The pharmaceutical composition of the present invention may comprise one or more pharmaceutically acceptable isotonic agents or tonicity-adjusting agents. Non-limiting examples of suitable isotonic agents include sugars (e.g. dextrose), sugar alcohols, sodium chloride, and the like. Further examples of suitable sugars include disaccharides like sucrose and trehalose. Exemplary, pharmaceutically acceptable sugar alcohols include glycerol, mannitol, and sorbitol.

In certain embodiments, the pharmaceutical composition of the present invention comprises an aqueous carrier and a pharmaceutically acceptable isotonic agent. In certain other embodiments, the pharmaceutical composition of the present invention comprises a salt and/or powder, such as, e.g. a freeze-dried, lyophilized, dehydrated, and/or cryodessicated composition comprising a pharmaceutically acceptable isotonic agent.

The pharmaceutical compositions of the present invention may comprise one or more pharmaceutically acceptable antioxidants. Exemplary pharmaceutically acceptable antioxidants include water soluble antioxidants, such as, e.g., ascorbic acid, cysteine hydrochloride, methionine, sodium bisulfate, sodium metabisulfite, sodium sulfite and the like; oil-soluble antioxidants, such as, e.g., ascorbyl palmitate, butylated hydroxyanisole (BHA), butylated hydroxytoluene (BHT), lecithin, propylgallate, alpha-tocopherol, and the like; and metal-chelating agents, such as, e.g., citric acid, ethylenediamine tetraacetic acid (EDTA), sorbitol, tartaric acid, phosphoric acid, and the like. In certain embodiments, the pharmaceutical composition of the present invention comprises an aqueous carrier and a pharmaceutically acceptable antioxidant. In certain other embodiments, the pharmaceutical composition of the present invention comprises a salt and/or powder, such as, e.g. a freeze-dried, lyophilized, dehydrated, and/or cryodessicated composition comprising a pharmaceutically acceptable antioxidant.

A pharmaceutical composition of the present invention may comprise one or more pharmaceutically acceptable surfactants and/or emulsifying agents (emulsifiers). Non-limiting examples of suitable surfactants and/or emulsifiers include polysorbates such as, e.g., polyoxyethylene (20) sorbitan monolaurate (polysorbate 20), polyoxyethylene (20) sorbitan monopalmitate (polysorbate 40), polyoxyethylene (20) sorbitan monostearate (polysorbate 60), and (polyoxyethylene (20) sorbitan monooleate (polysorbate 80). In certain embodiments, the pharmaceutical composition of the present invention comprises an aqueous carrier and a pharmaceutically acceptable surfactant and/or emulsifier. In certain other embodiments, the pharmaceutical composition of the present invention comprises a salt and/or powder, such as, e.g. a freeze-dried, lyophilized, dehydrated, and/or cryodessicated composition comprising a pharmaceutically acceptable surfactant and/or emulsifier. One or more surfactants and/or emulsifying agents may also be desirable in a pharmaceutical composition of the present invention to help prevent aggregation of the cell-targeting molecule of the present invention.

The pharmaceutical compositions of the present invention may comprise one or more pharmaceutically acceptable preservative agents. For example, preventing the presence of microorganisms may be ensured both by sterilization procedures, and by the inclusion of various antibacterial and antifungal agents, such as, e.g., paraben, chlorobutanol, phenol, sorbic acid, and the like in the compositions of the present invention.

A pharmaceutical composition of the present invention may comprise one or more pharmaceutically acceptable cryoprotective agents (cryoprotectants). Non-limiting examples of suitable cryoprotectants include ethylene glycol, glycerol, sucrose, and trehalose. In certain embodiments, the pharmaceutical composition of the present invention comprises an aqueous carrier and a pharmaceutically acceptable cryoprotectant. In certain other embodiments, the pharmaceutical composition of the present invention comprises a salt and/or powder, such as, e.g. a freeze-dried, lyophilized, dehydrated, and/or cryodessicated composition comprising a pharmaceutically acceptable cryoprotectant.

In addition, prolonged absorption of the injectable pharmaceutical form may be brought about by the inclusion of agents which delay absorption such as, e.g, a monostearate salt, aluminum monostearate, and/or gelatin.

In another aspect, the present invention provides pharmaceutical compositions comprising one or a combination of different polypeptides and/or cell-targeting molecules of the invention, or an ester, salt or amide of any of the foregoing, and at least one pharmaceutically acceptable carrier.

The pH of the pharmaceutical composition of the present invention can be adjusted with acids or bases, such as hydrochloric acid or sodium hydroxide, or buffers with acetate, citrate, histidine, succinate, phosphate, and the like. Non-limiting examples of pharmaceutically acceptable solvents or carriers for use in a pharmaceutical composition of the present invention include aqueous solutions comprising a cell-targeting molecule of the present invention and a buffer such as, e.g., citrate, histidine, phosphate, or succinate adjusted to pH 5.0, 6.0, 7.0, or 4.0, respectively. Certain embodiments of the present invention include compositions comprising one of the aforementioned solvents and/or carriers of the present invention.

Pharmaceutical compositions of the present invention that are solutions or suspensions used for intradermal or subcutaneous application typically include one or more of: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid, cysteine hydrochloride, methionine, sodium bisulfate, sodium metabisulfite, and sodium sulfite; chelating agents such as citric acid, ethylenediaminetetraacetic acid, sorbitol, tartaric acid, and phosphoric acid; surfactants such as a polysorbate; buffers such as acetate, citrate, histidine, and phosphate buffers; and tonicity adjusting agents such as, e.g., dextrose, glycerol, mannitol, sodium chloride, sorbitol, sucrose, and trehalose. Such preparations may be enclosed in ampoules, disposable syringes or multiple dose vials made of a glass or plastic.

Sterile injectable solutions may be prepared by incorporating a protein or cell-targeting molecule of the present invention in the required amount in an appropriate solvent with one or a combination of ingredients described above, as required, followed by sterilization microfiltration. Dispersions may be prepared by incorporating the active compound into a sterile vehicle that contains a dispersion medium and other ingredients, such as those described above. In the case of sterile powders for the preparation of sterile injectable solutions, the methods of preparation are vacuum drying and freeze-drying (lyophilization) that yield a powder of the active ingredient in addition to any additional desired ingredient from a sterile-filtered solution thereof. In certain embodiments, the pharmaceutical composition of the present invention comprises a powder comprising sorbitol, trehalose, sodium citrate, and polysorbate-20, and optionally, further comprises glycerol and/or methionine. In certain embodiments, the pharmaceutical composition of the present invention comprises sodium citrate, trehalose, and polysorbate-20, and optionally, further comprises glycerol and/or methionine.

When a therapeutically effective amount of a polypeptide and/or cell-targeting molecule of the invention is designed to be administered by, e.g. intravenous, cutaneous or subcutaneous injection, the binding agent will be in the form of a pyrogen-free, parenterally acceptable aqueous solution. Methods for preparing parenterally acceptable protein solutions, taking into consideration appropriate pH, isotonicity, stability, and the like, are within the skill in the art. A preferred pharmaceutical composition for intravenous, cutaneous, or subcutaneous injection will contain, in addition to binding agents, an isotonic vehicle such as sodium chloride injection, Ringer's injection, dextrose injection, dextrose and sodium chloride injection, lactated Ringer's injection, or other vehicle as known in the art.

In certain embodiments, the pharmaceutical composition of the present invention comprises sorbitol, sodium citrate, and polysorbate-20, and optionally, further comprises albumin, glycerol, and/or methionine. In certain embodiments, the pharmaceutical composition of the present invention comprises sorbitol, histidine, and polysorbate-20, and optionally, further comprises albumin, glycerol, and/or methionine.

The formulations of the pharmaceutical compositions of the invention may conveniently be presented in unit dosage form and may be prepared by any of the methods well known in the art of pharmacy. In such form, the composition is divided into unit doses containing appropriate quantities of the active component. The unit dosage form can be a packaged preparation, the package containing discrete quantities of the preparations, for example, packeted tablets, capsules, and powders in vials or ampoules. The unit dosage form can also be a capsule, cachet, or tablet itself, or it can be the appropriate number of any of these packaged forms. It may be provided in single dose injectable form, for example in the form of an autoinjector or pen. Compositions of the present invention may be formulated for any suitable route and means of administration. Subcutaneous or transdermal modes of administration may be particularly suitable for therapeutic molecules described herein.

As described elsewhere herein, a polypeptide and/or cell-targeting molecule of the present invention may be prepared with carriers that will protect the active therapeutic agent against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art (see e.g. Sustained and Controlled Release Drug Delivery Systems (Robinson J, ed., Marcel Dekker, Inc., NY, U.S., 1978)).

In certain embodiments, the composition of the present invention (e.g. a pharmaceutical and/or diagnostic composition) may be formulated to ensure a desired in vivo distribution of a cell-targeting molecule of the present invention. For example, the blood-brain barrier excludes many large and/or hydrophilic compounds. To target a therapeutic molecule or composition of the present invention to a particular in vivo location, they can be formulated, for example, in liposomes which may comprise one or more moieties that are selectively transported into specific cells or organs, thus enhancing targeted drug delivery. Exemplary targeting moieties include folate or biotin, mannosides, antibodies, surfactant protein A receptor, p120 catenin, and the like.

Pharmaceutical compositions include parenteral formulations designed to be used as implants or particulate systems. Examples of implants are depot formulations composed of polymeric or hydrophobic components such as emulsions, ion exchange resins, and soluble salt solutions. Examples of particulate systems are microspheres, microparticles, nanocapsules, nanospheres, and nanoparticles (see e.g. Honda M et al., *Int J Nanomedicine* 8: 495-503 (2013); Sharma A et al., *Biomed Res Int* 2013: 960821 (2013); Ramishetti S, Huang L, *Ther Deliv* 3: 1429-45 (2012)). Controlled release formulations may be prepared using polymers sensitive to ions, such as, e.g. liposomes, polaxamer 407, and hydroxyapatite.

VII. Polynucleotides, Expression Vectors, and Host Cells of the Present Invention Beyond the polypeptides and cell-targeting molecules of the present invention, the polynucleotides that encode the polypeptides, proteins, and cell-targeting molecules of the invention, or functional portions thereof, are also encompassed within the scope of the present invention. The term "polynucleotide" is equivalent to the term "nucleic acid," each of which includes one or more of: polymers of deoxyribonucleic acids (DNAs), polymers of ribonucleic acids (RNAs), analogs of these DNAs or RNAs generated using nucleotide analogs, and derivatives, fragments and homologs thereof. The polynucleotide of the present invention may be single-, double-, or triple-stranded. Such polynucleotides are specifically disclosed to include all polynucleotides capable of encoding an exemplary protein, for example, taking into account the wobble known to be tolerated in the third position of RNA codons, yet encoding for the same amino acid as a different RNA codon (see Stothard P, *Biotechniques* 28: 1102-4 (2000)).

In one aspect, the present invention provides polynucleotides which encode a Shiga toxin effector polypeptide and/or cell-targeting molecule of the present invention, or a fragment or derivative thereof. The polynucleotides may include, e.g., a nucleic acid sequence encoding a polypeptide at least 50%, 55%, 60%, 65%, 70%, 75%, 80%, 85%, 90%, 95%, 99% or more, identical to a polypeptide comprising one of the amino acid sequences of a polypeptide or cell-targeting molecule of the present invention. The invention also includes polynucleotides comprising nucleotide sequences that hybridize under stringent conditions to a polynucleotide which encodes Shiga toxin effector polypeptide and/or cell-targeting molecule of the invention, or a fragment or derivative thereof, or the antisense or complement of any such sequence.

Derivatives or analogs of the molecules of the present invention (e.g., Shiga toxin effector polypeptides of the present invention and cell-targeting molecules comprising the same) include, inter alia, polynucleotide (or polypeptide) molecules having regions that are substantially homologous to the polynucleotides (or Shiga toxin effector polypeptides and cell-targeting molecules of the present invention), e.g. by at least about 45%, 50%, 70%, 80%, 95%, 98%, or even 99% identity (with a preferred identity of 80-99%) over a polynucleotide (or polypeptide) sequence of the same size or when compared to an aligned sequence in which the alignment is done by a computer homology program known in the art. An exemplary program is the GAP program (Wisconsin Sequence Analysis Package, Version 8 for UNIX, Genetics Computer Group, University Research Park, Madison, Wis., U.S.) using the default settings, which uses the algorithm of Smith T, Waterman M, *Adv Appl Math* 2: 482-9 (1981). Also included are polynucleotides capable of hybridizing to the complement of a sequence encoding the cell-targeting proteins of the invention under stringent conditions (see e.g. Ausubel F et al., *Current Protocols in Molecular Biology* (John Wiley & Sons, New York, N.Y., U.S., 1993)), and below. Stringent conditions are known to those skilled in the art and may be found, e.g., in *Current Protocols in Molecular Biology* (John Wiley & Sons, NY, U.S., Ch. Sec. 6.3.1-6.3.6 (1989)).

The present invention further provides expression vectors that comprise the polynucleotides within the scope of the present invention. The polynucleotides capable of encoding the Shiga toxin effector polypeptides and/or cell-targeting molecules of the invention may be inserted into known vectors, including bacterial plasmids, viral vectors and phage vectors, using material and methods well known in the art to produce expression vectors. Such expression vectors will include the polynucleotides necessary to support production of contemplated Shiga toxin effector polypeptides and/or cell-targeting molecules of the invention within any host cell of choice or cell-free expression systems (e.g. pTxb1 and pIVEX2.3). The specific polynucleotides comprising expression vectors for use with specific types of host cells or cell-free expression systems are well known to one of ordinary skill in the art, can be determined using routine experimentation, and/or may be purchased.

The term "expression vector," as used herein, refers to a polynucleotide, linear or circular, comprising one or more expression units. The term "expression unit" denotes a polynucleotide segment encoding a polypeptide of interest and capable of providing expression of the nucleic acid segment in a host cell. An expression unit typically comprises a transcription promoter, an open reading frame encoding the polypeptide of interest, and a transcription terminator, all in operable configuration. An expression vector contains one or more expression units. Thus, in the context of the present invention, an expression vector encoding a Shiga toxin effector polypeptide and/or cell-targeting molecule of the invention comprising a single polypeptide chain includes at least an expression unit for the single polypeptide chain, whereas a protein comprising, e.g. two or more polypeptide chains (e.g. one chain comprising a $V_L$ domain and a second chain comprising a $V_H$ domain linked to a toxin effector polypeptide) includes at least two expression units, one for each of the two polypeptide chains of the protein. For expression of multi-chain cell-targeting proteins of the invention, an expression unit for each polypeptide chain may also be separately contained on different expression vectors (e.g. expression may be achieved with a single host cell into which expression vectors for each polypeptide chain has been introduced).

Expression vectors capable of directing transient or stable expression of polypeptides and proteins are well known in the art. The expression vectors generally include, but are not limited to, one or more of the following: a heterologous signal sequence or peptide, an origin of replication, one or more marker genes, an enhancer element, a promoter, and a transcription termination sequence, each of which is well known in the art. Optional regulatory control sequences, integration sequences, and useful markers that can be employed are known in the art.

The term "host cell" refers to a cell which can support the replication or expression of the expression vector. Host cells may be prokaryotic cells, such as *E. coli* or eukaryotic cells (e.g. yeast, insect, amphibian, bird, or mammalian cells). Creation and isolation of host cell lines comprising a polynucleotide of the invention or capable of producing a polypeptide and/or cell-targeting molecule of the present invention can be accomplished using standard techniques known in the art.

Shiga toxin effector polypeptides and/or proteins within the scope of the present invention may be variants or derivatives of the polypeptides and molecules described herein that are produced by modifying the polynucleotide encoding a polypeptide and/or proteinaceous component of a cell-targeting molecule by altering one or more amino acids or deleting or inserting one or more amino acids that may render it more suitable to achieve desired properties, such as more optimal expression by a host cell.

VIII. Delivery Devices and Kits

In certain embodiments, the invention relates to a device comprising one or more compositions of matter of the present invention, such as a pharmaceutical composition or diagnostic composition, for delivery to a subject in need thereof. Thus, a delivery device comprising one or more compositions of the present invention can be used to administer to a patient a composition of matter of the present invention by various delivery methods, including: intravenous, subcutaneous, intramuscular or intraperitoneal injection; oral administration; transdermal administration; pulmonary or transmucosal administration; administration by implant, osmotic pump, cartridge or micro pump; or by other means recognized by a person of skill in the art.

Also within the scope of the present invention are kits comprising at least one composition of matter of the invention, and optionally, packaging and instructions for use. Kits may be useful for drug administration and/or diagnostic information gathering. A kit of the invention may optionally comprise at least one additional reagent (e.g., standards, markers and the like). Kits typically include a label indicating the intended use of the contents of the kit. The kit may further comprise reagents and other tools for detecting a cell type (e.g. a tumor cell) in a sample or in a subject, or for diagnosing whether a patient belongs to a group that responds to a therapeutic strategy which makes use of a compound, composition, or related method of the present invention, e.g., such as a method described herein.

IX. Methods for Using Cell-Targeting Molecules of the Present Invention and/or Pharmaceutical and/or Diagnostic Compositions Thereof Generally, it is an object of the present invention to provide pharmacologically active agents, as well as compositions comprising the same, that can be used in the prevention and/or treatment of diseases, disorders, and conditions, such as certain cancers, tumors, growth abnormalities, immune disorders, or further pathological conditions mentioned herein. Accordingly, the present invention provides methods of using the polypeptides, cell-targeting molecules, and pharmaceutical compositions of the invention for the targeted killing of cells, for delivering additional exogenous materials into targeted cells, for labeling of the interiors of targeted cells, for collecting diagnostic information, for the delivering of T-cell epitopes to the WIC class I presentation pathway of target cells, and for treating diseases, disorders, and conditions as described herein. For example, the methods of the present invention may be used to prevent or treat cancers, cancer initiation, tumor initiation, metastasis, and/or disease reoccurrence.

In particular, it is an object of the invention to provide such pharmacologically active agents, compositions, and/or methods that have certain advantages compared to the agents, compositions, and/or methods that are currently known in the art. Accordingly, the present invention provides methods of using Shiga toxin effector polypeptides and cell-targeting molecules with specified protein sequences and pharmaceutical compositions thereof. For example, any of the amino acid sequences in SEQ ID NOs: 4-1140 may be specifically utilized as a component of the cell-targeting molecule used in the following methods or any method for using a cell-targeting molecule known to the skilled worker, such as, e.g., various methods described in WO 2014/164680, WO 2014/164693, WO 2015/138435, WO 2015/138452, WO 2015/113005; WO 2015/113007, WO 2015/138435, WO 2015/138452, US20150259428, WO 2015/191764, US20160177284, and WO 2016/126950.

The present invention provides methods of killing a cell comprising the step of contacting the cell, either in vitro or in vivo, with a Shiga toxin effector polypeptide, cell-targeting molecule, or pharmaceutical composition of the present invention. The Shiga toxin effector polypeptides, cell-targeting molecules, and pharmaceutical compositions of the present invention can be used to kill a specific cell type upon contacting a cell or cells with one of the claimed compositions of matter. In certain embodiments, a cell-targeting molecule or pharmaceutical composition of the present invention can be used to kill specific cell types in a mixture of different cell types, such as mixtures comprising cancer cells, infected cells, and/or hematological cells. In certain embodiments, a cell-targeting molecule, or pharmaceutical composition of the present invention can be used to kill cancer cells in a mixture of different cell types. In certain embodiments, a cytotoxic Shiga cell-targeting molecule, or pharmaceutical composition of the present invention can be used to kill specific cell types in a mixture of different cell types, such as pre-transplantation tissues. In certain embodiments, a Shiga toxin effector polypeptide, cell-targeting molecule, or pharmaceutical composition of the present invention can be used to kill specific cell types in a mixture of cell types, such as pre-administration tissue material for therapeutic purposes. In certain embodiments, a cell-targeting molecule or pharmaceutical composition of the present invention can be used to selectively kill cells infected by viruses or microorganisms, or otherwise selectively kill cells expressing a particular extracellular target biomolecule, such as a cell surface biomolecule. The Shiga toxin effector polypeptides, cell-targeting molecules, and pharmaceutical compositions of the present invention have varied applications, including, e.g., uses in depleting unwanted cell types from tissues either in vitro or in vivo, uses in modulating immune responses to treat graft versus host, uses as antiviral agents, uses as anti-parasitic agents, and uses in purging transplantation tissues of unwanted cell types.

In certain embodiments, certain Shiga toxin effector polypeptides, cell-targeting molecules, and pharmaceutical compositions of the present invention, alone or in combination with other compounds or pharmaceutical compositions, can show potent cell-kill activity when administered to a population of cells, in vitro or in vivo in a subject such as in a patient in need of treatment. By targeting the delivery of enzymatically active Shiga toxin A Subunit effector polypeptides and/or T-cell epitopes using high-affinity binding regions to specific cell types, cell-kill activities can be restricted to specifically and selectively killing certain cell types within an organism, such as certain cancer cells, neoplastic cells, malignant cells, non-malignant tumor cells, and/or infected cells.

The present invention provides a method of killing a cell in a patient in need thereof, the method comprising the step of administering to the patient at least one cell-targeting molecule of the present invention or a pharmaceutical composition thereof.

In certain embodiments, the cell-targeting molecule of the present invention or pharmaceutical compositions thereof can be used to kill a cancer cell in a patient by targeting an extracellular biomolecule found physically coupled with a cancer or tumor cell. The terms "cancer cell" or "cancerous cell" refers to various neoplastic cells which grow and divide in an abnormally accelerated and/or unregulated fashion and will be clear to the skilled person. The term "tumor cell" includes both malignant and non-malignant cells. Generally, cancers and/or tumors can be defined as diseases, disorders, or conditions that are amenable to treatment and/or prevention. The cancers and tumors (either malignant or non-malignant) which are comprised of cancer cells and/or tumor cells which may benefit from methods and compositions of the invention will be clear to the skilled person. Neoplastic cells are often associated with one or more of the following: unregulated growth, lack of differentiation, local tissue invasion, angiogenesis, and metastasis. The diseases, disorders, and conditions resulting from cancers and/or tumors (either malignant or non-malignant) which may benefit from the methods and compositions of the present invention targeting certain cancer cells and/or tumor cells will be clear to the skilled person.

Certain embodiments of the cell-targeting molecules and compositions of the present invention may be used to kill cancer stem cells, tumor stem cells, pre-malignant cancer-initiating cells, and tumor-initiating cells, which commonly are slow dividing and resistant to cancer therapies like chemotherapy and radiation. For example, acute myeloid leukemias (AMLs) may be treated with the present invention by killing AML stem cells and/or dormant AML progenitor cells (see e.g. Shlush L et al., *Blood* 120: 603-12 (2012)). Cancer stem cells often overexpress cell surface targets, such as, e.g., CD44, CD200, and others listed herein, which can be targets of certain binding regions of certain embodiments of the cell-targeting molecules of the present invention (see e.g. Kawasaki B et al., *Biochem Biophys Res Commun* 364:778-82 (2007); Reim F et al., *Cancer Res* 69: 8058-66 (2009)).

Because of the Shiga toxin A Subunit based mechanism of action, compositions of matter of the present invention may be more effectively used in methods involving their combination with, or in complementary fashion with other therapies, such as, e.g., chemotherapies, immunotherapies, radiation, stem cell transplantation, and immune checkpoint inhibitors, and/or effective against chemoresistant/radiation-resistant and/or resting tumor cells/tumor initiating cells/stem cells. Similarly, compositions of matter of the present invention may be more effectively used in methods involving in combination with other cell-targeted therapies targeting other than the same epitope on, non-overlapping, or different targets for the same disease disorder or condition.

Certain embodiments of the cell-targeting molecules of the present invention, or pharmaceutical compositions thereof, can be used to kill an immune cell (whether healthy or malignant) in a patient by targeting an extracellular biomolecule found physically coupled with an immune cell.

It is within the scope of the present invention to utilize a cell-targeting molecule of the present invention, or pharmaceutical composition thereof, for the purposes of purging patient cell populations (e.g. bone marrow) of malignant, neoplastic, or otherwise unwanted T-cells and/or B-cells and then reinfusing the T-cell and/or B-cells depleted material into the patient (see e.g. van Heeckeren W et al., *Br J Haematol* 132: 42-55 (2006); (see e.g. Alpdogan O, van den Brink M, *Semin Oncol* 39: 629-42 (2012)).

It is within the scope of the present invention to utilize the cell-targeting molecule of the present invention, or pharmaceutical composition thereof, for the purposes of ex vivo depletion of T cells and/or B-cells from isolated cell populations removed from a patient. In one non-limiting example, the cell-targeting molecule of the invention can be used in a method for prophylaxis of organ and/or tissue transplant rejection wherein the donor organ or tissue is perfused prior to transplant with a cytotoxic, cell-targeting molecule of the invention or a pharmaceutical composition thereof in order to purge the organ of donor T-cells and/or B-cells (see e.g. Alpdogan O, van den Brink M, *Semin Oncol* 39: 629-42 (2012)).

It is also within the scope of the present invention to utilize the cell-targeting molecule of the invention, or pharmaceutical composition thereof, for the purposes of depleting T-cells and/or B-cells from a donor cell population as a prophylaxis against graft-versus-host disease, and induction of tolerance, in a patient to undergo a bone marrow and or stem cell transplant (see e.g. van Heeckeren W et al., *Br J Haematol* 132: 42-55 (2006); (see e.g. Alpdogan O, van den Brink M, *Semin Oncol* 39: 629-42 (2012)).

In certain embodiments of the Shiga toxin effector polypeptide or cell-targeting molecule of the present invention, or pharmaceutical compositions thereof, can be used to kill an infected cell in a patient by targeting an extracellular biomolecule found physically coupled with an infected cell.

In certain embodiments of the cell-targeting molecules of the present invention, or pharmaceutical compositions thereof, can be used to "seed" a locus within a chordate with non-self, T-cell epitope-peptide presenting cells in order to activate the immune system to enhance policing of the locus. In certain further embodiments of this "seeding" method of the present invention, the locus is a tumor mass or infected tissue site. In preferred embodiments of this "seeding" method of the present invention, the non-self, T-cell epitope-peptide is selected from the group consisting of: peptides not already presented by the target cells of the cell-targeting molecule, peptides not present within any protein expressed by the target cell, peptides not present within the proteome or transcriptome of the target cell, peptides not present in the extracellular microenvironment of the site to be seeded, and peptides not present in the tumor mass or infect tissue site to be targeting.

This "seeding" method functions to label one or more target cells within a chordate with one or more MHC class I presented T-cell epitopes for recognition by effector T-cells and activation of downstream immune responses. By exploiting the cell internalizing, intracellularly routing, and T-cell epitope delivering functions of the cell-targeting molecules of the present invention, the target cells which display the delivered T-cell epitope are harnessed to induce recognition of the presenting target cell by host T-cells and induction of further immune responses including target-cell-killing by CTLs. This "seeding" method of using a cell-targeting molecule of the present invention can provide a temporary vaccination-effect by inducing adaptive immune responses to attack the cells within the seeded microenvironment, such as, e.g. a tumor mass or infected tissue site, whether presenting a cell-targeting molecule-delivered T-cell epitope(s) or not. This "seeding" method may also induce the breaking of immuno-tolerance to a target cell population, a tumor mass, and/or infected tissue site within a chordate.

Certain methods of the present invention involving the seeding of a locus within a chordate with one or more antigenic and/or immunogenic epitopes may be combined with the administration of immunologic adjuvants, whether administered locally or systemically, to stimulate the immune response to certain antigens, such as, e.g., the co-administration of a composition of the present invention with one or more immunologic adjuvants like a cytokine, bacterial product, or plant saponin. Other examples of immunologic adjuvants which may be suitable for use in the methods of the present invention include aluminum salts and oils, such as, e.g., alums, aluminum hydroxide, mineral oils, squalene, paraffin oils, peanut oils, and thimerosal.

Additionally, the present invention provides a method of treating a disease, disorder, or condition in a patient comprising the step of administering to a patient in need thereof a therapeutically effective amount of at least one of the cell-targeting molecules of the present invention, or a pharmaceutical composition thereof. Contemplated diseases, disorders, and conditions that can be treated using this method include cancers, malignant tumors, non-malignant tumors, growth abnormalities, immune disorders, and microbial infections. Administration of a "therapeutically effective dosage" of a composition of the present invention can result in a decrease in severity of disease symptoms, an increase in frequency and duration of disease symptom-free periods, or a prevention of impairment or disability due to the disease affliction.

The therapeutically effective amount of a composition of the present invention will depend on the route of administration, the type of organism being treated, and the physical characteristics of the specific patient under consideration. These factors and their relationship to determining this amount are well known to skilled practitioners in the medical arts. This amount and the method of administration can be tailored to achieve optimal efficacy, and may depend on such factors as weight, diet, concurrent medication and other factors, well known to those skilled in the medical arts. The dosage sizes and dosing regimen most appropriate for human use may be guided by the results obtained by the present invention, and may be confirmed in properly designed clinical trials. An effective dosage and treatment protocol may be determined by conventional means, starting with a low dose in laboratory animals and then increasing the dosage while monitoring the effects, and systematically varying the dosage regimen as well. Numerous factors may be taken into consideration by a clinician when determining an optimal dosage for a given subject. Such considerations are known to the skilled person.

An acceptable route of administration may refer to any administration pathway known in the art, including but not limited to aerosol, enteral, nasal, ophthalmic, oral, parenteral, rectal, vaginal, or transdermal (e.g. topical administration of a cream, gel or ointment, or by means of a transdermal patch). "Parenteral administration" is typically associated with injection at or in communication with the intended site of action, including infraorbital, infusion, intraarterial, intracapsular, intracardiac, intradermal, intramuscular, intraperitoneal, intrapulmonary, intraspinal, intrasternal, intrathecal, intrauterine, intravenous, subarachnoid, subcapsular, subcutaneous, transmucosal, or transtracheal administration.

For administration of a pharmaceutical composition of the present invention, the dosage range will generally be from about 0.001 to 10 milligrams per kilogram (mg/kg), and more, usually 0.001 to 0.5 mg/kg, of the subject's body weight. Exemplary dosages may be 0.01 mg/kg body weight, 0.03 mg/kg body weight, 0.07 mg/kg body weight, 0.9 mg/kg body weight or 0.1 mg/kg body weight or within the range of 0.01 to 0.1 mg/kg. An exemplary treatment regime is a once or twice daily administration, or a once or twice weekly administration, once every two weeks, once every three weeks, once every four weeks, once a month, once every two or three months or once every three to 6 months. Dosages may be selected and readjusted by the skilled health care professional as required to maximize therapeutic benefit for a particular patient.

Pharmaceutical compositions of the present invention will typically be administered to the same patient on multiple occasions. Intervals between single dosages can be, for example, two to five days, weekly, monthly, every two or three months, every six months, or yearly. Intervals between administrations can also be irregular, based on regulating blood levels or other markers in the subject or patient. Dosage regimens for a composition of the present invention include intravenous administration of 1 mg/kg body weight or 3 mg/kg body weight with the composition administered every two to four weeks for six dosages, then every three months at 3 mg/kg body weight or 1 mg/kg body weight.

A pharmaceutical composition of the present invention may be administered via one or more routes of administration, using one or more of a variety of methods known in the art. As will be appreciated by the skilled worker, the route and/or mode of administration will vary depending upon the desired results. Routes of administration for cell-targeting molecules and pharmaceutical compositions of the present invention include, e.g. intravenous, intramuscular, intradermal, intraperitoneal, subcutaneous, spinal, or other parenteral routes of administration, for example by injection or infusion. For other embodiments, a cell-targeting molecule or pharmaceutical composition of the invention may be administered by a non-parenteral route, such as a topical, epidermal or mucosal route of administration, for example, intranasally, orally, vaginally, rectally, sublingually, or topically.

Therapeutic cell-targeting molecules or pharmaceutical compositions of the present invention may be administered with one or more of a variety of medical devices known in the art. For example, in one embodiment, a pharmaceutical composition of the invention may be administered with a needleless hypodermic injection device. Examples of well-known implants and modules useful in the present invention are in the art, including e.g., implantable micro-infusion pumps for controlled rate delivery; devices for administering through the skin; infusion pumps for delivery at a precise infusion rate; variable flow implantable infusion devices for continuous drug delivery; and osmotic drug delivery systems. These and other such implants, delivery systems, and modules are known to those skilled in the art.

The cell-targeting molecule or pharmaceutical composition of the present invention may be administered alone or in combination with one or more other therapeutic or diagnostic agents. A combination therapy may include a cell-targeting molecule of the present invention, or pharmaceutical composition thereof, combined with at least one other therapeutic agent selected based on the particular patient, disease or condition to be treated. Examples of other such agents include, inter alia, a cytotoxic, anti-cancer or chemotherapeutic agent, an anti-inflammatory or anti-proliferative agent, an antimicrobial or antiviral agent, growth factors, cytokines, an analgesic, a therapeutically active small molecule or polypeptide, a single chain antibody, a classical antibody or fragment thereof, or a nucleic acid molecule which modulates one or more signaling pathways, and similar modulating therapeutic molecules which may complement or otherwise be beneficial in a therapeutic or prophylactic treatment regimen.

Treatment of a patient with cell-targeting molecule or pharmaceutical composition of the present invention preferably leads to cell death of targeted cells and/or the inhibition of growth of targeted cells. As such, cytotoxic, cell-targeting molecules of the present invention, and pharmaceutical compositions comprising them, will be useful in methods for treating a variety of pathological disorders in which killing or depleting target cells may be beneficial, such as, inter alia, cancer, tumors, other growth abnormalities, immune disorders, and infected cells. The present invention provides methods for suppressing cell proliferation, and treating cell disorders, including neoplasia, overactive B-cells, and overactive T-cells.

In certain embodiments, the cell-targeting molecules and pharmaceutical compositions of the present invention can be used to treat or prevent cancers, tumors (malignant and non-malignant), growth abnormalities, immune disorders, and microbial infections. In a further aspect, the above ex vivo method can be combined with the above in vivo method to provide methods of treating or preventing rejection in bone marrow transplant recipients, and for achieving immunological tolerance.

In certain embodiments, the present invention provides methods for treating malignancies or neoplasms and other blood cell associated cancers in a mammalian subject, such as a human, the method comprising the step of administering to a subject in need thereof a therapeutically effective amount of a cytotoxic cell-targeting molecule or pharmaceutical composition of the present invention.

The cell-targeting molecules and pharmaceutical compositions of the present invention have varied applications, including, e.g., uses in removing unwanted T-cells, uses in modulating immune responses to treat graft versus host, uses as antiviral agents, uses as antimicrobial agents, and uses in purging transplantation tissues of unwanted cell types. The cell-targeting molecules and pharmaceutical compositions of the present invention are commonly anti-neoplastic agents—meaning they are capable of treating and/or preventing the development, maturation, or spread of neoplastic or malignant cells by inhibiting the growth and/or causing the death of cancer or tumor cells.

In certain embodiments, the cell-targeting molecule or pharmaceutical composition of the present invention is used to treat a B-cell-, plasma cell- or antibody-mediated disease or disorder, such as for example leukemia, lymphoma, myeloma, Human Immunodeficiency Virus-related diseases, amyloidosis, hemolytic uremic syndrome, polyarteritis, septic shock, Crohn's Disease, rheumatoid arthritis, ankylosing spondylitis, psoriatic arthritis, ulcerative colitis, psoriasis, asthma, Sjögren's syndrome, graft-versus-host disease, graft rejection, diabetes, vasculitis, scleroderma, and systemic lupus erythematosus.

In another aspect, certain embodiments of the cell-targeting molecules and pharmaceutical compositions of the present invention are antimicrobial agents—meaning they are capable of treating and/or preventing the acquisition, development, or consequences of microbiological pathogenic infections, such as caused by viruses, bacteria, fungi, prions, or protozoans.

It is within the scope of the present invention to provide a prophylaxis or treatment for diseases or conditions mediated by T-cells or B-cells by administering the cell-targeting molecule the present invention, or a pharmaceutical composition thereof, to a patient for the purpose of killing T-cells or B-cells in the patient. This usage is compatible with preparing or conditioning a patient for bone marrow transplantation, stem cell transplantation, tissue transplantation, or organ transplantation, regardless of the source of the transplanted material, e.g. human or non-human sources.

It is within the scope of the present invention to provide a bone marrow recipient for prophylaxis or treatment of host-versus-graft disease via the targeted cell-killing of host T-cells using a cytotoxic cell-targeting molecule or pharmaceutical composition of the present invention.

Certain embodiments of the cell-targeting molecules and pharmaceutical compositions of the present invention can be utilized in a method of treating cancer comprising administering to a patient, in need thereof, a therapeutically effective amount of a cell-targeting molecule and/or pharmaceutical composition of the present invention. In certain embodiments of the methods of the present invention, the cancer being treated is selected from the group consisting of: bone cancer (such as multiple myeloma or Ewing's sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi's sarcoma, or synovial sarcoma), skin cancer (such as basal cell carcinoma, squamous cell carcinoma, or melanoma), and uterine cancer.

Certain embodiments of the cell-targeting molecules and pharmaceutical compositions of the present invention can be utilized in a method of treating an immune disorder comprising administering to a patient, in need thereof, a therapeutically effective amount of the cell-targeting molecules and/or pharmaceutical composition of the present invention. In certain embodiments of the methods of the present invention, the immune disorder is related to an inflammation associated with a disease selected from the group consisting of: amyloidosis, ankylosing spondylitis, asthma, Crohn's disease, diabetes, graft rejection, graft-vs.-host disease, Hashimoto's thyroiditis, hemolytic uremic syndrome, HIV-related diseases, lupus erythematosus, multiple sclerosis, polyarteritis, psoriasis, psoriatic arthritis, rheumatoid arthritis, scleroderma, septic shock, Sjögren's syndrome, ulcerative colitis, and vasculitis.

Among certain embodiments of the present invention is using the Shiga toxin effector polypeptide or cell-targeting molecule of the present invention as a component of a pharmaceutical composition or medicament for the treatment or prevention of a cancer, tumor, other growth abnormality, immune disorder, and/or microbial infection. For example, immune disorders presenting on the skin of a patient may be treated with such a medicament in efforts to reduce inflammation. In another example, skin tumors may be treated with such a medicament in efforts to reduce tumor size or eliminate the tumor completely.

Certain cytotoxic cell-targeting molecules of the present invention, and compositions thereof, may be used in molecular neurosurgery applications such as immunolesioning and neuronal tracing. For example, the targeting domain may be selected or derived from various ligands, such as neurotransmitters and neuropeptides, which target specific neuronal cell types by binding neuronal surface receptors, such as a neuronal circuit specific G-protein coupled receptor. Similarly, the targeting domain may be selected from or derived from antibodies that bind neuronal surface receptors. Because certain Shiga toxin effector polypeptides robustly direct their own retrograde axonal transport, certain cell-targeting molecules of the present invention may be used to kill a neuron(s) which expresses the extracellular target at a site of cytotoxic protein injection distant from the cell body, These targeted cytotoxic molecules of the invention that specifically target neuronal cell types have uses in neuroscience research, such as for elucidating mechanisms of sensations, and creating model systems of neurodegenerative diseases, such as Parkinson's and Alzheimer's.

Among certain embodiment of the present invention is a method of using a Shiga toxin effector polypeptide, cell-targeting molecule, pharmaceutical composition, and/or diagnostic composition of the present invention to label or detect the interiors of neoplastic cells and/or immune cell types. This method may be based on the ability of certain cell-targeting molecules of the present invention to enter specific cell types and route within cells via retrograde intracellular transport, to the interior compartments of specific cell types are labeled for detection. This can be performed on cells in situ within a patient or on cells and tissues removed from an organism, e.g. biopsy material.

Among certain embodiment of the present invention is a method of using a Shiga toxin effector polypeptide, cell-targeting molecule, pharmaceutical composition, and/or diagnostic composition of the present invention to detect the presence of a cell type for the purpose of information gathering regarding diseases, conditions and/or disorders. The method comprises contacting a cell with a diagnostically sufficient amount of a cell-targeting molecule of the present invention in order to detect the molecule by an assay or diagnostic technique. The phrase "diagnostically sufficient amount" refers to an amount that provides adequate detection and accurate measurement for information gathering purposes by the particular assay or diagnostic technique utilized. Generally, the diagnostically sufficient amount for whole organism in vivo diagnostic use will be a non-cumulative dose of between 0.001 to 10 milligrams of the detection-promoting agent linked cell-targeting molecule of the invention per kg of subject per subject.

Typically, the amount of Shiga toxin effector polypeptide or cell-targeting molecule of the invention used in these information gathering methods will be as low as possible provided that it is still a diagnostically sufficient amount. For example, for in vivo detection in an organism, the amount of Shiga toxin effector polypeptide, cell-targeting molecule, or pharmaceutical composition of the invention administered to a subject will be as low as feasibly possible.

The cell-type specific targeting of cell-targeting molecules of the present invention combined with detection-promoting agents provides a way to detect and image cells physically coupled with an extracellular target biomolecule of a binding region of the molecule of the invention. Imaging of cells using the cell-targeting molecules of the present invention may be performed in vitro or in vivo by any suitable technique known in the art. Diagnostic information may be collected using various methods known in the art, including whole body imaging of an organism or using ex vivo samples taken from an organism. The term "sample" used herein refers to any number of things, but not limited to, fluids such as blood, urine, serum, lymph, saliva, anal secretions, vaginal secretions, and semen, and tissues obtained by biopsy procedures. For example, various detection-promoting agents may be utilized for non-invasive in vivo tumor imaging by techniques such as magnetic resonance imaging (MRI), optical methods (such as direct, fluorescent, and bioluminescent imaging), positron emission tomography (PET), single-photon emission computed tomography (SPECT), ultrasound, x-ray computed tomography, and combinations of the aforementioned (see, Kaur S et al., Cancer Lett 315: 97-111 (2012), for review).

Among certain embodiment of the present invention is a method of using a Shiga toxin effector polypeptide, cell-targeting molecule, or pharmaceutical composition of the present invention in a diagnostic composition to label or detect the interiors of a hematologic cell, cancer cell, tumor cell, infected cell, and/or immune cell (see e.g., Koyama Y et al., *Clin Cancer Res* 13: 2936-45 (2007); Ogawa Metal., *Cancer Res* 69: 1268-72 (2009); Yang L et al., *Small* 5: 235-43 (2009)). Based on the ability of certain cell-targeting molecules of the invention to enter specific cell types and route within cells via retrograde intracellular transport, the interior compartments of specific cell types are labeled for detection. This can be performed on cells in situ within a patient or on cells and tissues removed from an organism, e.g. biopsy material.

Diagnostic compositions of the present invention may be used to characterize a disease, disorder, or condition as potentially treatable by a related pharmaceutical composition of the present invention. In certain compositions of matter of the present invention may be used to determine whether a patient belongs to a group that responds to a therapeutic strategy which makes use of a compound, composition or related method of the present invention as described herein or is well suited for using a delivery device of the invention.

Diagnostic compositions of the present invention may be used after a disease, e.g. a cancer, is detected in order to better characterize it, such as to monitor distant metastases, heterogeneity, and stage of cancer progression. The phenotypic assessment of disease disorder or infection can help prognostic and prediction during therapeutic decision making. In disease reoccurrence, certain methods of the invention may be used to determine if local or systemic problem.

Diagnostic compositions of the present invention may be used to assess responses to therapies regardless of the type of the type of therapy, e.g. small molecule drug, biological drug, or cell-based therapy. For example, certain embodiments of the diagnostics of the invention may be used to measure changes in tumor size, changes in antigen positive cell populations including number and distribution, or monitoring a different marker than the antigen targeted by a therapy already being administered to a patient (see Smith-Jones P et al., *Nat. Biotechnol* 22: 701-6 (2004); Evans M et al., *Proc. Natl. Acad. Sci. USA* 108: 9578-82 (2011)).

In certain embodiments of the method used to detect the presence of a cell type may be used to gather information regarding diseases, disorders, and conditions, such as, for example bone cancer (such as multiple myeloma or Ewing's sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi's sarcoma, or synovial sarcoma), skin cancer (such as basal cell carcinoma, squamous cell carcinoma, or melanoma), uterine cancer, AIDS, amyloidosis, ankylosing spondylitis, asthma, autism, cardiogenesis, Crohn's disease, diabetes, erythematosus, gastritis, graft rejection, graft-versus-host disease, Grave's disease, Hashimoto's thyroiditis, hemolytic uremic syndrome, HIV-related diseases, lupus erythematosus, lymphoproliferative disorders (including post-transplant lymphoproliferative disorders), multiple sclerosis, myasthenia gravis, neuroinflammation, polyarteritis, psoriasis, psoriatic arthritis, rheumatoid arthritis, scleroderma, septic shock, Sjögren's syndrome, systemic lupus erythematosus, ulcerative colitis, vasculitis, cell proliferation, inflammation, leukocyte activation, leukocyte adhesion, leukocyte chemotaxis, leukocyte maturation, leukocyte migration, neuronal differentiation, acute lymphoblastic leukemia (ALL), T acute lymphocytic leukemia/lymphoma (ALL), acute myelogenous leukemia, acute myeloid leukemia (AML), B-cell chronic lymphocytic leukemia (B-CLL), B-cell prolymphocytic lymphoma, Burkitt's lymphoma (BL), chronic lymphocytic leukemia (CLL), chronic myelogenous leukemia (CIVIL-BP), chronic myeloid leukemia (CIVIL), diffuse large B-cell lymphoma, follicular lymphoma, hairy cell leukemia (HCL), Hodgkin's Lymphoma (HL), intravascular large B-cell lymphoma, lymphomatoid granulomatosis, lymphoplasmacytic lymphoma, MALT lymphoma, mantle cell lymphoma, multiple myeloma (MM), natural killer cell leukemia, nodal marginal B-cell lymphoma, Non-Hodgkin's lymphoma (NHL), plasma cell leukemia, plasmacytoma, primary effusion lymphoma, pro-lymphocytic leukemia, promyelocytic leukemia, small lymphocytic lymphoma, splenic marginal zone lymphoma, T-cell lymphoma (TCL), heavy chain disease, monoclonal gammopathy, monoclonal immunoglobulin deposition disease, myelodusplastic syndromes (MDS), smoldering multiple myeloma, and Waldenstrom macroglobulinemia.

The present invention is further illustrated by the following non-limiting examples of 1) Shiga toxin effector polypeptides of the present invention, 2) cell-targeting molecules of the present invention, and 3) cytotoxic, cell-targeting molecules of the present invention comprising the aforementioned polypeptides and capable of specifically targeting certain cell types.

EXAMPLES

The following examples demonstrate certain embodiments of the present invention. However, it is to be understood that these examples are for illustration purposes only and do not intend, nor should any be construed, to be wholly definitive as to conditions and scope of this invention. The experiments in the following examples were carried out using standard techniques, which are well known and routine to those of skill in the art, except where otherwise described in detail.

Site-specific conjugation strategies based on unique amino acid residues can help control homogeneity of the product(s) of a conjugation reaction, such as, e.g., strategies using engineered cysteine residues, unnatural amino acid residues, and/or enzymatic conjugation. By using unique conjugation sites, heterogeneity may be minimized and the resulting compositions become more consistent from batch to batch and have predictable properties.

These examples describe the creation and testing of various molecules, each comprising an amino acid residue for site-specific conjugation to various molecules, such as, e.g., a unique, free cysteine or lysine residue in a Shiga toxin effector polypeptide or Shiga toxin effector polypeptide scaffold, whether the unique, free cysteine or lysine residue is positioned ectopically or at a naturally occurring position). In certain examples, the Shiga toxin effector polypeptides are de-immunized as described in WO 2015/113007. In certain examples, the Shiga toxin effector polypeptides comprise an embedded, heterologous, CD8+ T-cell epitope as described in WO 2015/113005. In certain examples, the Shiga toxin effector polypeptides comprise a disrupted furin-cleavage motif at the carboxy-terminus of a Shiga toxin A1 fragment derived region that confers reduced protease cleavage sensitivity to the Shiga toxin effector polypeptide as a component of certain molecules as described in WO 2015/191764. In certain examples, the Shiga toxin effector polypeptides are de-immunized, comprise an embedded, heterologous, CD8+ T-cell epitope, and comprise a disrupted furin-cleavage motif at the carboxy-terminus of a Shiga toxin A1 fragment as described in WO 2016/196344.

Exemplary, Shiga toxin effector polypeptides were tested for the retention of Shiga toxin effector function(s) as components of exemplary, cell-targeting molecules of the present invention. The retention of potent cytotoxicity by a Shiga toxin effector polypeptide component of a cell-targeting molecules implicates the retention by that Shiga toxin effector polypeptide of a certain, minimum level of retrograde intracellular routing to the cytosol. The presence of free cysteine residues in exemplary cell-targeting molecules was demonstrated by the formation of intermolecular disulfide bonds linking cell-targeting protein monomers.

The presence of one or more ectopic, free cysteine residues and/or a unique lysine residue in a Shiga toxin A Subunit effector scaffold provides an amenable attachment point for linking various molecules to the Shiga toxin effector polypeptide scaffold at specific residues in a controlled fashion. Such linked molecules may be (1) cell-targeting agents; (2) cell-targeting, proteinaceous molecules; (3) cargos designed for intracellular delivery, including for controlled liberation; and/or (4) agents having extracellular function(s), such as, e.g., biologically inert moieties which prolong half-life in a vertebrate and/or mask immunogenic portions of the scaffold. The conjugation of cell-targeting molecules comprising Shiga toxin A Subunit effectors to a cargo (such as a cytotoxic "payload") allows for the targeted delivery of the cargo or "payload" to an internal location of target cells. Examples of cargos include DNA, RNA, nucleic acid complexes, enzymes, proteins, peptides, fluorescent proteins or peptides, and cytotoxic small molecules. Certain examples show exemplary, cell-targeting molecules comprising a Shiga toxin effector polypeptide having an ectopic, cysteine residue conjugated using standard techniques to a cargo, such as, e.g., a peptide, nucleic acid, protein, protein-nucleic acid complex, cytotoxic agent, antibiotic, and/or detection-promoting agent.

Example 1. Exemplary, Shiga Toxin Effector Polypeptides of the Present Invention Comprising a Cysteine Residue(s) for Site-Specific Conjugation In this Example, exemplary Shiga toxin A Subunit effector polypeptides of the present invention (SLT-1A-Cys(p)-variant), where Cys(p) represents a cysteine residue engineered at a unique position), each comprising one ectopic cysteine residue, were created and tested as components of exemplary cell-targeting molecules of the present invention.

A. Constructing Exemplary, Shiga Toxin Effector Polypeptides of the Present Invention by Adding Free Cysteine Residues Via Amino Acid Residue Substitution This section describes the creation of various scaffolds comprising Shiga toxin effector polypeptides, each comprising one ectopic, cysteine residue. The ectopic, cysteine residues were engineered into Shiga toxin effector polypeptides as genetically encoded substitutions which did not change the overall number of amino acid residues in the polypeptide. Exemplary, cell-targeting molecules of the present invention (e.g. SLT-1A-Cys(p)-variant::scFv(n)) were created using these Shiga toxin effector polypeptides.

In this Example, cell-targeting molecules, each comprising a Shiga toxin A Subunit effector polypeptide having one ectopic, cysteine residue, were created and tested. These cell-targeting molecules each comprised a cell-targeting, immunoglobulin-type, binding region comprising a polypeptide capable of binding to an extracellular target biomolecule with high-affinity.

The parental, Shiga toxin effector polypeptide of this Example is the A1 fragment of Shiga-like toxin (SLT-1A1) comprising the substitution C242S to remove the only endogenous, cysteine residue (SEQ ID NO:4). The mutation of the cysteine at position 242 to a serine (C242S) had no apparent effect on catalytic activity of the A1 fragment. Using standard techniques, the parental, Shiga toxin effector polypeptide is used to make various Shiga toxin effector polypeptides, each having one ectopic cysteine residue and no other cysteine residues (see e.g. Table 1). Cell-targeting molecules (see e.g. SEQ ID NOs: 773-783) comprising Shiga toxin effector polypeptides (see e.g. SEQ ID NOs: 5-84) having exactly one of the ectopic cysteine residues described in Table 1 were made using standard techniques and tested in one or more of the experiments described below.

TABLE 1

Ectopic, Cysteine Residues Engineered into Shiga Toxin Effector Polypeptides

| Exemplary, Shiga toxin effector polypeptides | Cysteine Substitution | Sequence Variants (SLT-1A-Cys(p)-variant)) |
|---|---|---|
| SLT-1A-Cys1 | K1C | SEQ ID NOs: 5, 15, 25, 35, 45, 55, 65, 75, 85, 95, 105, and 115 |
| SLT-1A-Cys2 | S8C | SEQ ID NOs: 6, 16, 26, 36, 46, 56, 66, 76, 86, 96, 106, and 116 |
| SLT-1A-Cys3 | S16C | SEQ ID NOs: 7, 17, 27, 37, 47, 57, 67, 77, 87, 97, 107, and 117 |
| SLT-1A-Cys4 | S22C | SEQ ID NOs: 8, 18, 28, 38, 48, 58, 68, 78, 88, 98, 108, and 118 |
| SLT-1A-Cys5 | S33C | SEQ ID NOs: 9, 19, 29, 39, 49, 59, 69, 79, 89, 99, 109, 119, and 1101 |
| SLT-1A-Cys6 | S43C | SEQ ID NOs: 10, 20, 30, 40, 50, 60, 70, 80, 90, 100, 110, and 120 |
| SLT-1A-Cys7 | S45C | SEQ ID NOs: 11, 21, 31, 41, 51, 61, 71, 81, 91, 101, 111, 121, and 1102 |
| SLT-1A-Cys8 | S146C | SEQ ID NOs: 12, 22, 32, 42, 52, 62, 72, 82, 92, 102, 112, 122, and 1103 |
| SLT-1A-Cys9 | S186C | SEQ ID NOs: 13, 23, 33, 43, 53, 63, 73, 83, 93, 103, 123, and 1104 |
| SLT-1A-Cys10 | V54C | SEQ ID NOs: 14, 24, 34, 44, 54, 64, 74, 84, 94, 104, 114, and 124 |

B. Testing Shiga Toxin a Subunit Effector Polypeptides for Retention of Shiga Toxin Functions Shiga toxin effector polypeptides and molecules comprising the same can be tested for Shiga toxin functions using techniques known to the skilled worker (see e.g. WO 2014/164680, WO 2014/164693, WO 2015/113005; WO 2015/113007; WO 2015/138435, WO 2015/138452, WO 2015/191764, US20160177284; WO 2016/126950). Exemplary, cell-targeting molecules were tested for Shiga toxin A Subunit functions. The Shiga toxin A Subunit functions analyzed were: catalytic activity, inhibition of eukaryotic ribosome function, cytotoxicity, and by inference self-directing subcellular routing to the cytosol. 1. Testing Shiga Toxin Catalytic Activity and Ability to Inhibit Ribosome Function The catalytic activities of Shiga toxin effector polypeptide components of exemplary, cell-targeting molecules were tested using a ribosome inhibition assay. Catalytic activities were tested for exemplary, cell-targeting molecules comprising exemplary, Shiga toxin effector polypeptides of the present invention (SEQ ID NOs: 9, 11, and 14).

The ribosome inactivation capabilities of exemplary, cell-targeting molecules of this Example were determined using a cell-free, in vitro protein translation assay based on the TNT® Quick Coupled Transcription/Translation Kit (L1170, Promega Corp., Madison, Wis., U.S.). The ribosome activity reaction was prepared according to manufacturer's instructions. A series of 10-fold dilutions of the cell-targeting molecule to be tested was prepared in an appropriate buffer and a series of identical, TNT reaction mixtures were created for each dilution. Each sample in the dilution series was combined with each of the TNT reaction mixtures along with Luciferase T7 Control DNA (L4821, Promega Corp., Madison, Wis., U.S.). The test samples were incubated for 1.5 hours at 30 degrees Celsius (° C.). After the incubation, Luciferase Assay Reagent (E1483, Promega Corp., Madison, Wis., U.S.) was added to all test samples and the amount of luciferase protein present was measured by luminescence according to manufacturer's instructions. A positive control was tested: the wild-type, Shiga-like toxin A1 fragment (SLT-1A1-WT) (SEQ ID NO:830). This cell-free, in vitro, protein translation assay was used to determine the ribosome inactivation capabilities of SLT-1A-Cys5::scFv1 (SEQ ID NO:781), SLT-1A-Cys7::scFv1 (SEQ ID NO:782), and SLT-1A-Cys10::scFv1 (SEQ ID NO:783).

The level of translational inhibition was determined by non-linear regression analysis of log-transformed concentrations of total protein versus relative luminescence units (RLU). Using Prism software (GraphPad Prism, San Diego, Calif., U.S.), the half maximal inhibitory concentration ($IC_{50}$) value was calculated for each sample using the Prism software function of log(inhibitor) vs. response (three parameters) [Y=Bottom+((Top−Bottom)/(1+10^(X−Log $IC_{50}$)))] under the heading dose-response-inhibition. The $IC_{50}$ values for each cell-targeting molecule from one or more experiments was calculated and is shown in Table 2 in picomolar (pM). In this assay, measurements of the inhibition of protein synthesis represent the ribosome inactivation activity of the sample molecule, which is one metric of the catalytic activity of a Shiga toxin effector polypeptide. Any molecule which exhibits an $IC_{50}$ within 10-fold of a reference molecule is considered herein to exhibit ribosome inhibition activity comparable to the reference molecule. As reported in the Examples, a molecule exhibiting an $IC_{50}$ less than or within 10 percent of an $IC_{50}$ exhibited by a reference molecule is considered to exhibit ribosome inhibition activity equivalent to that reference molecule.

TABLE 2

Ribosome Inhibition Activities of Exemplary, Cell-Targeting Molecules

| Molecule Tested | Cysteine position | Ribosome Inhibition $IC_{50}$ (pM) |
|---|---|---|
| SLT-1A-Cys5::scFv1 (SEQ ID NO: 781) | C33 | 190 |
| SLT-1A-Cys7::scFv1 (SEQ ID NO: 782) | C45 | 109 |
| SLT-1A-Cys10::scFv1 (SEQ ID NO: 783) | C54 | 78 |
| SLT-1A1-WT (wild-type) (SEQ ID NO: 830) | none | 185 |

The ribosome inactivation activities of all the Shiga toxin effector polypeptides SLT-1A-Cys(p) tested in the context of a cell-targeting molecule were equivalent to the catalytic activity of a wild-type, Shiga toxin A1 fragment (Table 2). As shown in Table 2, exemplary cell-targeting molecules comprising or consisting of SEQ ID NO: 781, 782, or 783 exhibited potent ribosome inhibition equivalent to the positive control of an isolated Shiga toxin A Subunit effector polypeptide consisting of a wild-type, Shiga toxin A1 fragment (SEQ ID NO:830). The results of this assay showed that multiple, exemplary, Shiga toxin effector polypeptides of the present invention (SEQ ID NOs: 9, 11, and 14) exhibited catalytic activity in the context of a cell-targeting molecule equivalent to the activity of a wild-type, Shiga toxin effector polypeptide that comprised a single, endogenous cysteine residue at position 242 (Table 2). In other experiments, it was demonstrated that cell-targeting molecules comprising mutated Shiga toxin effector polypeptides having no cysteine residues or only a single free cysteine residue, the endogenous cysteine residue at position 242 (e.g. a wild-type SLT-1A1 (amino acids 1-251 of SEQ ID NO:1)), exhibited catalytic activity comparable to the activity of each other and to the activity of a cell-targeting molecule comprising a wild-type, Shiga toxin effector polypeptide (amino acids 1-251 of SEQ ID NO:1).

2. Testing the Cytotoxic Activities of Exemplary, Cell-Targeting Molecules of the Invention The potency and specificity of cytotoxic activities of exemplary, cell-targeting molecules were tested to assess the functions of their Shiga toxin effector polypeptide components. The cytotoxic activities of exemplary, cell-targeting molecules, which each comprised a Shiga toxin effector polypeptide SLT-1A-Cys(p), were determined using a tissue culture cell-based cytotoxicity assay known to the skilled worker ("cell-kill assay"). The cytotoxicities of exemplary, cell-targeting molecules were determined using cells expressing, at a cellular surface, significant amounts of the appropriate, extracellular target biomolecule, such as, a target of the binding region scFv1, scFv2, scFv3, and/or scFv4. The cells used in this Example were immortalized, human tumor cells available from the ATCC (Manassas Va., U.S.), National Cancer Institute of the U.S. (Frederick, Md., U.S.), and/or DSZM (Braunschweig, DE). The cells referred to below were HCC-1954, MDA-MB-231, H929, ST486, L1236, HCC827, Daudi, HDLM-2, and U-266, or more simply cell-lines A, B, C, D, E, F, G, H and I, respectively. Certain cell-targeting molecules were tested using cell-kill assays involving both target biomolecule positive and target biomolecule negative cells with respect to the target biomolecule of each cell-targeting molecule's binding region.

The cytotoxicity assays were performed as follows. Certain, human tumor cell-line cells were plated (typically at $2\times10^3$ cells per well for adherent cells, plated the day prior to cell-targeting molecule addition, or $7.5\times10^3$ cells per well for suspension cells, plated the same day as cell-targeting molecule addition) in 20 μL cell culture medium in 384-well plates. A series of 10-fold dilutions of the molecules to be tested was prepared in an appropriate buffer, and 5 μL of the dilutions or buffer control were added to the plated cells. Control wells containing only cell culture medium were used for baseline correction. The cell samples were incubated with the cell-targeting molecule or just buffer for 3 or 5 days at 37° C. and in an atmosphere of 5% carbon dioxide ($CO_2$). The total cell survival or percent viability was determined using a luminescent readout using the CellTiter-Glo® Luminescent Cell Viability Assay or RealTime-Glo® MT Cell Viability Assay (Promega Corp., Madison, Wis., U.S.) according to the manufacturer's instructions.

The Percent Viability of experimental wells was calculated using the following equation: (Test RLU−Average Media RLU)÷(Average Cells RLU−Average Media RLU)×100. The logarithm of the cell-targeting molecule protein concentration versus Percent Viability was plotted in Prism (GraphPad Prism, San Diego, Calif., U.S.) and log (inhibitor) versus response (3 parameter) analysis or and log (inhibitor) versus normalized response analysis were used to determine the half-maximal cytotoxic concentration ($CD_{50}$) value for the tested molecule. The $CD_{50}$ value(s) for each molecule tested were calculated, when possible, and shown in Table 3. When $CD_{50}$ values could not be calculated based on the shape of the curve over the concentrations tested, then a maximum $CD_{50}$ value was noted as being beyond the maximum tested value, e.g., greater than 100 nanomolar (">100 nM") or 200 nanomolar (">200 nM"), for samples which did not kill 50% of the cells at the highest, tested, sample concentration, e.g., 100 or 200 nanomolar (nM). In some experiments, biomolecule target negative cells treated with the maximum concentration of the cell-targeting molecule did not show any change in viability as compared to a buffer only control. As reported in the Examples herein, a molecule exhibiting a $CD_{50}$ within 10-fold of a $CD_{50}$ exhibited by a reference molecule is considered to exhibit cytotoxic activity comparable to that reference molecule. Cell-targeting molecules that exhibited a $CD_{50}$ to a biomolecule target positive cell population within 100-fold to 10-fold of a reference molecule comprising the same binding region and a related Shiga toxin effector polypeptide component lacking any cysteine residue is referred to herein as active but "attenuated." The $CD_{50}$ values for exemplary, cell-targeting molecules are shown in Table 3 and associated cell-kill assay data is shown in FIGS. 2-3. The molecules tested for cytotoxic activity in this Example included cell-targeting molecules comprising or consisting of SLT-1A-Cys5::scFv1 (SEQ ID NO:781), SLT-1A-Cys7::scFv1 (SEQ ID NO:782), SLT-1A-Cys10::scFv1 (SEQ ID NO:783), SLT-1A-Cys2-D1::scFv2 (SEQ ID NO:773), SLT-1A-Cys2-D1::scFv3 (SEQ ID NO:780), SLT-1A-Cys3-D1::scFv3 (SEQ ID NO:779), SLT-1A-Cys5-D1::scFv3 (SEQ ID NO:778), SLT-1A-Cys6-D1::scFv2 (SEQ ID NO:774), SLT-1A-Cys7-D1::scFv2 (SEQ ID NO:775), SLT-1A-Cys8-D1::scFv2 (SEQ ID NO:776), SLT-1A-Cys9-D1::scFv2 (SEQ ID NO:777), SLT-1A1-WT (SEQ ID NO:830), SLT-1A-D1::scFv2 (SEQ ID NO:838), SLT-1A-D1 (SEQ ID NO:831), SLT-1A-D1-C242::scFv3 (SEQ ID NO:837), and SLT-1A-D1::scFv3 (SEQ ID NO:839).

TABLE 3

Cytotoxic Activities of Exemplary, Cell-Targeting Molecules

| Molecule tested | SLT-1A Cysteine position | Cell-type tested (target positive or negative) | Cytotoxicity $CD_{50}$ (nM) | Cell-type tested (target positive or negative) | Cytotoxicity $CD_{50}$ (nM) |
|---|---|---|---|---|---|
| Experiment 1 | | | | | |
| SLT-1A-Cys5::scFv1 | C33 | Cell Line A (positive) | 0.67 | Cell Line B (negative) | >200 nM |
| SLT-1A-Cys7::scFv1 | C45 | Cell Line A (positive) | 0.44 | Cell Line B (negative) | >200 nM |
| SLT-1A-Cys10::scFv1 | C54 | Cell Line A (positive) | 0.42 | Cell Line B (negative) | >200 nM |
| SLT-1A1-WT | C242 | Cell Line A (n/a) | 373.00 | Cell Line B (n/a) | >200 nM |
| Experiment 2 | | | | | |
| SLT-1A-Cys2-D1::scFv2 | c8 | Cell Line C (positive) | 0.0023 | Cell Line D (positive) | 0.0074 |
| SLT-1A-Cys6-D1::scFv2 | C43 | Cell Line C (positive) | 0.0041 | Cell Line D (positive) | 0.0588 |
| SLT-1A-Cys7-D1::scFv2 | C45 | Cell Line C (positive) | 0.0012 | Cell Line D (positive) | 0.0063 |
| SLT-1A-Cys8-D1::scFv2 | C146 | Cell Line C (positive) | 0.0010 | Cell Line D (positive) | 0.0038 |
| SLT-1A-Cys9-D1::scFv2 | C186 | Cell Line C (positive) | 0.0046 | Cell Line D (positive) | 0.0176 |
| SLT-1A-D1::scFv2 | none | Cell Line C (positive) | 0.0026 | Cell Line D (positive) | 0.0073 |
| SLT-1A-D1 | none | Cell Line C (n/a) | >100 nM | Cell Line D (n/a) | >100 nM |
| Experiment 3 | | | | | |
| SLT-1A-Cys2-D1::scFv3 | C8 | Cell Line E (positive) | 54.8 | | |
| SLT-1A-Cys3-D1::scFv3 | C16 | Cell Line E (positive) | 34.8 | | |
| SLT-1A-Cys5-D1::scFv3 | C33 | Cell Line E (positive) | 17.4 | | |
| SLT-1A-D1-C242::scFv3 | C242 | Cell Line E (positive) | 40.3 | | |
| SLT-1A-D1::scFv3 | none | Cell Line E (positive) | 55.7 | | |

* "n/a" denotes that the presence or absence of a particular target biomolecule is irrelevant because the molecule tested was untargeted The exemplary cell-targeting molecules of the present invention represented by SLT-1A-Cys5::scFv1 (SEQ ID NO:781), SLT-1A-Cys7::scFv1 (SEQ ID NO:782), SLT-1A-Cys10::scFv1 (SEQ ID NO:783), SLT-1A-Cys2-D1::scFv2 (SEQ ID NO:773), SLT-1A-Cys2-D1::scFv3 (SEQ ID NO:780), SLT-1A-Cys3-D1::scFv3 (SEQ ID NO:779), SLT-1A-Cys5-D1::scFv3 (SEQ ID NO:778), SLT-1A-Cys6-D1::scFv2 (SEQ ID NO:774), SLT-1A-Cys7-D1::scFv2 (SEQ ID NO:775), SLT-1A-Cys8-D1::scFv2 (SEQ ID NO:776), and SLT-1A-Cys9-D1::scFv2 (SEQ ID NO:777) were each cytotoxic to target positive cells, commonly exhibiting $CD_{50}$ values less than 100 nM. The results reported in Table 3 show that cell-targeting molecules comprising any of the Shiga toxin effector polypeptides SLT-1A-Cys5 (SEQ ID NO:9), SLT-1A-Cys7 (SEQ ID NO:11), SLT-1A-Cys10 (SEQ ID NO:14) were cytotoxic to target positive cells at potencies associated with $CD_{50}$ values generally less than 100 nM to 5 micromolar (04) depending on the cell-line tested (see Table 3; FIGS. 2-3). The cytotoxicities of many of the Shiga toxin effector polypeptides tested as a component of a cell-targeting molecule were comparable to the cytotoxicities of a related, Shiga toxin effector polypeptide (either lacking any cysteine residues (SEQ ID NO:831) or having the endogenous cysteine at position 242 (SEQ ID NO:832), as a component of a related, cell-targeting molecule (SEQ ID NO:837) (Table 3; FIGS. 2-3).

FIG. 2 shows the potent cytotoxic activities exhibited by three different exemplary cell-targeting molecules of the present invention SLT-1A-Cys5::scFv1 (SEQ ID NO:781), SLT-1A-Cys7::scFv1 (SEQ ID NO:782), and SLT-1A-Cys10::scFv1 (SEQ ID NO:783) as compared to the untargeted SLT-1A1-WT alone (SEQ ID NO:830) toward target positive cells (top panel), and as compared to their activities to target negative cells (bottom panel).

FIG. 3 shows the cytotoxic activities exhibited by three different exemplary cell-targeting molecules of the present invention: SLT-1A-Cys2-D1::scFv2 (SEQ ID NO:773), SLT-1A-Cys7-D1::scFv2 (SEQ ID NO:775), and SLT-1A-Cys8-D1::scFv2 (SEQ ID NO:776); and the cytotoxic activities shown in FIG. 3 were comparable to the activities displayed by a related cell-targeting molecule (SLT-1A-D1::scFv2 (SEQ ID NO:838), which comprised a Shiga toxin effector polypeptide lacking any cysteine residue (SEQ ID NO:831).

The specificity of the cytotoxic activity of a given cell-targeting molecule can be determined by comparing cell-kill activities toward cells expressing a significant amount of a target biomolecule of the binding region of the cell-targeted molecule (target positive cells) with cell-kill activities toward cells which do not have any significant amount of any target biomolecule of the binding region of the cell-targeted molecule physically coupled to any cellular surface (target negative cells). This was accomplished by comparing the $CD_{50}$ value(s) of a given cell-targeting molecule toward a cell population(s) which were positive for cell surface expression of the target biomolecule of the cell-targeting molecule being analyzed to the $CD_{50}$ value(s) of the same molecule toward a cell population(s) which were negative for cell surface expression of any target biomolecule of the molecule being analyzed.

The results of the cell-kill assays described above and shown in Table 3 and FIGS. 2-3 indicated that the introduction of various, ectopic, cysteine residues in various, Shiga toxin effector polypeptide scaffolds was possible without significantly impairing the Shiga toxin A Subunit functions of catalytic activity, catalytic inactivation of eukaryotic ribosomes, cytotoxicity, and by inference self-directing subcellular routing to the cytosol.

Example 2. Exemplary, Cell-Targeting Molecules of the Present Invention that Comprise a Free Cysteine Residue Outside the Toxin Effector Region In this Example, exemplary cell-targeting molecules of the present invention, each comprising one free cysteine residue outside any toxin effector region, were created and tested.

A. Constructing Exemplary, Cell-Targeting Molecules of the Present Invention that Comprise a Free Cysteine Residue Outside all Shiga Toxin Effector Polypeptide Components This section describes the creation of various cell-targeting molecules comprising a free cysteine residue. Using standard techniques, cysteine residues were engineered into cell-targeting proteins as genetically encoded substitutions which did not change the overall number of amino acid residues in the cell-targeting protein. In this Example, each cell-targeting molecule that was tested comprised a cell-targeting, immunoglobulin-type, binding region comprising a polypeptide capable of binding to an extracellular target biomolecule with high-affinity (see Table 4). Protein expression and purification of these cell-targeting molecules was performed using standard techniques known to the skilled worker and/or as previously described (see e.g. WO 2014/164680, WO 2014/164693, WO 2015/138435, WO 2015/138452, WO 2015/191764, and WO 2016/126950), such as using Capto™-L (GE Healthcare, Marlborough, Mass., U.S.).

TABLE 4

Free Cysteine Residues Engineered into Cell-Targeting Proteins

| Cell-Targeting Molecule Component | Free Cysteine location | Exemplary, Cell-Targeting Molecules with Component |
|---|---|---|
| linker-Cys1 (SEQ ID NO: 757) | between Binding Region and Toxin Effector Region | SEQ ID NOs: 803-806 |
| linker-Cys2 (SEQ ID NO: 758) | between Binding Region and Toxin Effector Region | |
| linker-Cys3 (SEQ ID NO: 759) | between Binding Region and Toxin Effector Region | |
| linker-Cys4 (SEQ ID NO: 760) | between Binding Region and Toxin Effector Region | |
| scFv-linker-Cys1 (SEQ ID NO: 769) | between the scFv's heavy and light variable regions | SEQ ID NOs: 807-808 |
| scFv-linker-Cys2 (SEQ ID NO: 770) | between the scFv's heavy and light variable regions | SEQ ID NOs: 809-811 |
| scFv-linker-Cys3 (SEQ ID NO: 771) | between the scFv's heavy and light variable regions | |
| scFv-linker-Cys4 (SEQ ID NO: 772) | between the scFv's heavy and light variable regions | |
| scFv(n)-Cys-C2 | penultimate C-terminal residue of Binding Region | SEQ ID NOs: 812-815 |
| $V_HH$(n)-Cys-C2 | penultimate C-terminal residue of Binding Region | SEQ ID NOs: 816-817 |

B. Testing the Cytotoxic Activities of Exemplary, Cell-Targeting Molecules of the Invention The potency and specificity of cytotoxic activities of exemplary, cell-targeting molecules of the present invention were tested to assess the functionalities of their Shiga toxin effector polypeptide components. The cytotoxic activities of exemplary, cell-targeting molecules, which each comprised one of the following components: linker-Cys(p), scFv(n)-linker-Cys(p), or scFv(n)-Cys(p) were determined using the cell-kill assay described in Example 1 (above). The cytotoxicities of exemplary, cell-targeting molecules were determined using cells expressing, at a cellular surface, significant amounts of the appropriate, extracellular target biomolecule of scFv2. Using the cytotoxicity assay, the $CD_{50}$ value(s) for each molecule tested were calculated (Table 5), and associated cell-kill assay data is shown in FIG. 4. When $CD_{50}$ values could not be calculated based on the shape of the curve over the concentrations tested, then a maximum $CD_{50}$ value was noted as being beyond the maximum tested value, e.g., greater than 100 nM (">100 nM"), for samples which did not kill 50% of the cells at the highest, tested, sample concentration, e.g., 100 nM. Cytotoxic activities were tested for exemplary, cell-targeting molecules of the present invention such as, e.g., cell-targeting molecules comprising or consisting of SEQ ID NO: 803, 807, and 812.

TABLE 5

| Cytotoxic Activities of Exemplary, Cell-Targeting Molecules | | | | | |
|---|---|---|---|---|---|
| Molecule Tested | Free Cysteine location | Cell-type tested (target positive or negative) | Cytotoxicity $CD_{50}$ (nM) | Cell-type tested (target positive or negative) | Cytotoxicity $CD_{50}$ (nM) |
| SLT-1A-D1:: linker-Cys1::scFv2 (SEQ ID NO: 803) | between Toxin Effector and Binding Region | Cell Line C (positive) | 0.0006 | Cell Line D (positive) | 0.0089 |
| SLT-1A-D1:: scFv2-linker-Cys1 (SEQ ID NO: 807) | between variable domains of seFv2 | Cell Line C (positive) | 0.0038 | Cell Line D (positive) | 0.0273 |
| SLT-1A-D1:: scFv2-Cys-C2 (SEQ ID NO: 812) | in variable domain of scFv2 | Cell Line C (positive) | 0.0002 | Cell Line D (positive) | 0.002 |
| SLT-1A-D1::scFv2 (SEQ ID NO: 838) | none | Cell Line C (positive) | 0.0026 | Cell Line D (positive) | 0.0073 |
| SLT-1A-D1 (SEQ ID NO: 831) | none | Cell Line C (n/a) | >100 nM | Cell Line D (n/a) | >100 nM |

Table 5 and FIG. 4 show experimental results from examples of cell targeting molecules comprising a free, cysteine residue outside any Shiga toxin effector polypeptide component(s) (e.g., SLT-1A-D1::linker-Cys1::scFv2 (SEQ ID NO:803), SLT-1A-D1::scFv2-linker-Cys1 (SEQ ID NO:807), and SLT-1A-D1::scFv2-Cys-C2 (SEQ ID NO:812). The cytotoxic activities of SLT-1A-D1::linker-Cys1::scFv2 (SEQ ID NO:803), SLT-1A-D1::scFv2-linker-Cys1 (SEQ ID NO:807), and SLT-1A-D1::scFv2-Cys-C2 (SEQ ID NO:812) were comparable to the activity of the parental molecule SLT-1A-D1::scFv2 (SEQ ID NO:838), which lacks any cysteine residue in its Shiga toxin effector polypeptide component. The results reported in Table 5 show that the cell-targeting molecules comprising or consisting of SLT-1A-D1::linker-Cys1::scFv2, SLT-1A-D1::scFv2-linker-Cys1, and SLT-1A-D1::scFv2-Cys-C2 were all cytotoxic to target positive cells, with $CD_{50}$ values of less than 30 pM. The cytotoxicities of the Shiga toxin effector polypeptide component (SLT-1A-D1 (SEQ ID NO:831)) of these cell-targeting molecules was comparable to the cytotoxicity of the identical Shiga toxin effector polypeptide (SLT-1A-D1 (SEQ ID NO:831)) as a component of the positive control, reference molecule SLT-1A-D1::scFv2 (SEQ ID NO:837) (see Table 5; FIG. 4).

Example 3. Testing Purified, Cell-Targeting Molecules for Intermolecular Disulfide Bonding Certain, exemplary, cell-targeting molecules of this Example where produced and purified using routine methods known to the skilled worker and then analyzed for intermolecular associations. The cell-targeting molecules tested in this Example included those which comprise a single free cysteine residue such as #1) SLT-1A-D1-C242::scFv3 (SEQ ID NO:838), #2) SLT-1A-Cys2-D1::scFv2 (SEQ ID NO:773), #3) SLT-1A-Cys2-D1::scFv3 (SEQ ID NO:780), #4) SLT-1A-Cys3-D1::scFv3 (SEQ ID NO:779), #5) SLT-1A-Cys5-D1::scFv3 (SEQ ID NO:778), #6) SLT-1A-Cys6-D1::scFv2 (SEQ ID NO:774), #7) SLT-1A-Cys7-D1::scFv2 (SEQ ID NO:775), #8) SLT-1A-Cys8-D1::scFv2 (SEQ ID NO:776), #9) SLT-1A-Cys9-D1::scFv2 (SEQ ID NO:777), #10) SLT-1A-D1::linker-Cys1::scFv2 (SEQ ID NO:803), #11) SLT-1A-D1::scFv2-linker-Cys1 (SEQ ID NO:807), and #12) SLT-1A-D1::scFv2-Cys-C2 (SEQ ID NO:812) as well as other cell-targeting molecules used as various controls such as SLT-1A-D1::scFv2 (SEQ ID NO:838) and SLT-1A-D1::scFv3 (SEQ ID NO:839).

Exemplary, cell-targeting molecule preparations were analyzed by sodium dodecyl sulfate (SDS) polyacrylamide gel electrophoresis (SDS-PAGE). Exemplary, cell-targeting molecules and the reference molecules SLT-1A-D1::scFv(n) were loaded in equal concentrations to replicate, 4-20%, SDS-PAGE gels (Lonza, Basel, CH) and electrophoresed under denaturing conditions or denaturing and reducing conditions. The resulting gels were analyzed by COOMASSIE staining for intermolecular associations indicative of disulfide bond formation (shown in FIGS. 5 and 6).

In FIGS. 5-6, the left side shows COOMASSIE-stained SDS-PAGE gels run under reducing and denaturing conditions, and the right side shows replicate, COOMASSIE-stained SDS-PAGE gels run under non-reducing, denaturing conditions. The Figure legends list the samples loaded and run in each lane of the replicate gels. The first lane marked "MW Marker" shows the migration pattern of a protein molecular weight ladder, and the approximate size of each ladder protein band is labeled in kiloDaltons (kDa).

In FIG. 5, the samples loaded and run in lanes numbered 2-6 are indicated in the figure legend: #2) SLT-1A-D1::scFv3 (SEQ ID NO:839), #3) SLT-1A-D1-C242::scFv3 (SEQ ID NO:837), #4) SLT-1A-Cys5-D1::scFv3 (SEQ ID NO:778), #5) SLT-1A-Cys3-D1::scFv3 (SEQ ID NO:779), and #6) SLT-1A-Cys2-D1::scFv3 (SEQ ID NO:780).

In FIG. 6, the samples loaded and run in lanes numbered 2-10 are indicated in the figure legend: #2) SLT-1A-Cys2-D1::scFv2 (SEQ ID NO:773), #3) SLT-1A-Cys6-D1::scFv2 (SEQ ID NO:774), #4) SLT-1A-Cys8-D1::scFv2 (SEQ ID NO:776), #5) SLT-1A-Cys9-D1::scFv2 (SEQ ID NO:777), #6) SLT-1A-D1::linker-Cys1::scFv2 (SEQ ID NO:803), #7) SLT-1A-D1::scFv2-linker-Cys1 (SEQ ID NO:807), #8) SLT-1A-D1::scFv2-Cys-C2 (SEQ ID NO:812), #9) SLT-1A-Cys7-D1::scFv2 (SEQ ID NO:775), and #10) SLT-1A-D1::scFv2 (SEQ ID NO:838).

The results of this analysis and as shown in FIGS. 5-6 was that intermolecular disulfide bond based multimerization had occurred in the samples with SLT-1A-Cys5-D1::scFv3 (SEQ ID NO:778), SLT-1A-Cys6-D1::scFv2 (SEQ ID NO:774), SLT-1A-Cys7-D1::scFv2 (SEQ ID NO:775), SLT-1A-Cys8-D1::scFv2 (SEQ ID NO:776), and SLT-1A-Cys9-D1::scFv2 (SEQ ID NO:777). In addition, truncations of certain, cell-targeting molecules were observed for some of the samples analyzed, and the size of the truncation matches the expected size of a purification intermediate.

To further analyze the nature of intermolecular associations formed among purified, exemplary, cell-targeting molecules, two samples were further purified and analyzed. Samples of the exemplary, cell-targeting molecules SLT-1A-Cys2-D1::scFv2 and SLT-1A-Cys7-D1::scFv2 used in the experiments above were run over a size exclusion chromatography (SEC) column (Superdex 200 Increase, GE Healthcare, Marlborough, Mass., U.S.) and compared to commercial, molecular-size migration reference standards to estimate sizes (see e.g. FIGS. 7-8). Through the use of molecular-size migration standards and knowledge of possible molecular species present in a sample, the size of molecular species in a peak may be estimated and the identity of the molecular species in a peak may be inferred. Alternatively or in addition, complimentary methods (e.g. SDS-PAGE or mass spectroscopy) known to the skilled worker and/or described herein may be used to more definitively determine the molecule(s) composed in certain peaks.

Molecules of known sizes and migration characteristics (standards) were analyzed in order to calibrate which retention times corresponded to which protein sizes and/or protein sizes were predicted from the amino acid composition and/or SDS-PAGE analyses of the purified protein present in the sample to be analyzed. Chromatographic data collected from commercial size standards were used to create calibration curves to help estimate sizes of molecular species in samples and focus analyses on specific retention time ranges.

The results of the experiments shown in FIGS. 6 and 7 indicate that the dimeric protein in the SLT-1A-Cys2-D1::scFv2 (SEQ ID NO:773) sample was not predominantly comprised by covalent dimers but instead was comprised predominantly by non-covalent dimeric complexes. This may indicate that the cysteine residue at position 8 in SEQ ID NO:26 was merely unavailable to intermolecularly pair with other cysteine residues at position 8 of SEQ ID NO:26 or that more generally the cysteine residue at position 8 of SEQ ID NO:26 is not available for pairing to molecules of a certain size (e.g. polypeptides larger than 25 amino acid residues) or to any molecule at all (e.g., buried in the hydrophobic core of the protein and/or tightly packed within a secondary structure).

The results of the experiments shown in FIGS. 6 and 8 indicate that the protein in the SLT-1A-Cys7-D1::scFv2 (SEQ ID NO:775) sample was comprised by redox-sensitive, covalent dimeric complexes as well as by non-covalent dimeric complexes, indicating that the cysteine residue at position 45 in SEQ ID NO:31 is available for pairing to proteinaceous molecules, including relatively large polypeptides and proteins (e.g. having a mass of about 50-60 kDa). The ectopic cysteine at position 45 of the Shiga toxin effector polypeptide mediated a covalent interaction between two molecules of SLT-1A-Cys7-D1:scFv2. Thus, it can be inferred that the cysteine residue at position 45 of the Shiga toxin effector polypeptide is surface-accessible and more generally unavailable for pairing with cysteine residues in other molecules.

Example 4. Constructing Cargo-Linked, Cell-Targeting Molecules Comprising Exemplary, Shiga Toxin A Subunit Effector Polypeptides of the Present Invention Exemplary cell-targeting molecules of the present invention (SEQ ID NOs: 789, 791-793, 804, 808, 813, and 1141) were produced, purified and conjugated to a maleimide-activated fluorescent dye using routine methods known to the skilled worker. The maleimide-activated fluorescent dyes used were Alexa Fluor® 488 C5 Maleimide and Alexa Fluor® 555 C2 Maleimide (Thermo Fisher Scientific, Waltham, Mass., U.S.).

For each sample, 200 microgram (μg) of an exemplary cell-targeting molecule was incubated with 2 mM TCEP at pH 7 and room temperature for twenty minutes. A 5-fold molar excess of either the 488 or 555 maleimide-activated dye was added to each sample, and chemical reactions were allowed to proceed at room temperature for one hour. Then for each sample, protein was separated from unbound dye using a purification resin according to the manufacturer's instructions (Antibody Conjugate Purification Kit, Catalog #A33088, Thermo Fisher Scientific, Waltham, Mass., U.S.), and the protein concentration was estimated by measuring each sample's absorbance of light of a wavelength of 280 nM.

The method of conjugation used (i.e. the chemical reaction during the one-hour incubation period) was intended to link the maleimide functional group of the dye to a free cysteine residue of a polypeptide component of the cell-targeting molecule. As a control, a related cell-targeting molecule lacking any free cysteine was subjected to the same chemical reaction and method steps described above.

In certain embodiments, exemplary cell-targeting molecules of the present invention comprise a mutation known in the art to cause the inactivation of the toxin effector component(s) of the cell-targeting molecule. For example, Shiga toxin effector polypeptides comprising the mutation E167D, wherein 167 refers to the native position of a Shiga toxin A Subunit, is referred to in the Examples herein as IA-SLT-1A, with the IA indicating catalytically inactive or catalytically impaired for noncytotoxic or reduced-cytotoxicity variants as a result of severely reduced catalytic activity consistent with descriptions in the scientific literature and as would be recognized by the skilled worker (see e.g. Hovde C et al., *Proc Natl Acad Sci USA* 85: 2568-72 (1988); Jackson M et al., *J Bacteriol* 172: 3346-50 (1990); Gordon V et al., *Infect Immun* 60: 485-90 (1992); Ohmura M et al., *Microb Pathog* 15: 169-76 (1993)). Exemplary, cell-targeting molecules were created and tested in Example 5, including cell-targeting molecules comprising a Shiga toxin effector polypeptide(s) comprising the E167D mutation: IA-SLT-1A-D1 (SEQ ID NO:834), IA-SLT-1A-Cys5-D1 variant 2 (SEQ ID NO:1101), IA-SLT-1A-Cys7-D1 (SEQ ID NO:1102), IA-SLT-1A-Cys8-D1 (SEQ ID NO:1103), or IA-SLT-1A-Cys9-D1 (SEQ ID NO:1104)).

Example 5. Testing Cargo-Linked Cell-Targeting Molecules of the Present Invention That Comprise a Cargo Linked to a Site-Specific Free Cysteine Residue Cargo-linked cell-targeting molecules were tested for cell-targeting molecule functions (e.g. target binding, cell binding, cellular internalization, intracellular routing efficiency, and cell-killing) using standard techniques known to the skilled worker (see e.g. WO 2014/164680, WO 2014/164693, WO 2015/113005, WO 2015/113007, WO 2015/138435, WO 2015/138452, US 2015/0259428, and WO 2015/191764). Exemplary, cell-targeting molecules were tested for Shiga toxin A Subunit functions of cellular internalization and cytotoxicity, and by inference catalytic activity, inhibition of eukaryotic ribosome function, and self-directing subcellular routing to the cytosol. The potency and specificity of cytotoxic activities of exemplary, cargo-linked cell-targeting molecules of the present invention were tested based on the exemplary cell-targeting molecule comprising or consisting of SEQ ID NO:789. In addition, cellular internalization of cargo by cargo-linked cell-targeting molecules was tested to demonstrate cargo delivery functionality of cell-targeting molecules which each comprised a cargo linked to a specific cysteine residue.

A. Testing Cargo-Linked Cell-Targeting Molecules for Retention of Cell-Targeting Exemplary, cargo-linked cell-targeting molecules were tested for cell binding, and by inference target biomolecule binding function, using routine techniques known to the skilled worker. The cell-binding ability of each dye-linked cell-targeting molecule was measured by standard flow cytometry assays known to the skilled worker (e.g. fluorescence-activated cell sorting (FACS)) using immortalized human cell lines that either expressed at a cellular surface the target of the cell-targeting molecule (cell lines C and G) or, as a negative control, cells that did not express the target of the cell-targeting molecule being tested on the cell surface (Cell line H).

For each sample and cell-type tested, 300,000 cells were incubated on ice for one hour in media containing 200 nM of each dye-linked cell-targeting molecule sample. Then the cells were washed, re-suspended in PBS, and analyzed using a BD Accuri™ C6 flow cytometer according to the manufacturer's instructions (BD Biosciences, San Jose, Calif., U.S.). As assay controls for each specific target, each cell line was tested in the same assay using a monoclonal antibody specific to the same target conjugated to fluorescein isothiocyanate (FITC) as a positive control and an isotype negative monoclonal antibody specific to the same target conjugated to FITC as a negative control. Thus, 300,000 cells from each cell line tested were incubated on ice for one hour in media containing one µg of either a positive control antibody or a negative control antibody and analyzed with the same method and parameters. The FACS analysis of each sample involved the sorting of living cells by gating based on forward versus side scatter. The FACS gate for positive was based on the isotype negative control samples (encompassing the negative population) and confirmed with a positive control monoclonal antibody (e.g. anti-target2 mAb-FITC).

The exemplary cell-targeting molecules tested in this assay included: IA-SLT-1A-Cys5-D1::scFv2 (SEQ ID NO:1141), SLT-1A-Cys5-D1::scFv2 (SEQ ID NO:789), IA-SLT-1A-Cys7-D1::scFv2 (SEQ ID NO:793), IA-SLT-1A-Cys8-D1::scFv2 (SEQ ID NO:791), IA-SLT-1A-Cys9-D1::scFv2 (SEQ ID NO:792), IA-SLT-1A-DI:Jinker-Cys1::scFv2 (SEQ ID NO:804), IA-SLT-1A-DI::scFv2-linker-Cys1 (SEQ ID NO:808), and IA-SLT-1A-DI::scFv2-Cys1 (SEQ ID NO:813). The results of the FACS cell-binding assay measurements for cells incubated with 200 nM of cell-targeting molecule or control antibody are listed in Table 6 and some representative FACS histogram overlay data is shown in FIGS. 9-11. In FIGS. 9-11, the number of cells counted (cell count) is plotted over the fluorescence intensity in the FL1-A channel. In FIGS. 9-11, the gray line denotes the negative population as measured using the isotype negative control sample and the black line denotes the dye-linked cell-targeting molecule or antibody positive control (anti-target2 mAb-FITC). In Table 6, the percentage of cells counted in the positive gate is indicated as "percent positive" for each cell line tested. Table 6 also lists the iMFI (indexed mean fluorescent intensity), the product of the MFI and the percentage positive, for each target positive cell line tested. In Table 6, "N/A" refers to 'not applicable' as the monoclonal antibody listed here was used as a positive control for cell surface binding to the target biomolecule of the experimental cell-targeting molecules.

TABLE 6

Exemplary, Cargo-Linked Cell-Targeting Molecules Exhibited Binding to Target Positive Cells at Cell-Targeting Molecule Concentrations of 200 nM

| | | target positive Cell Line C | | target positive Cell Line G | | target negative Cell Line H |
|---|---|---|---|---|---|---|
| Molecule Tested by linking to dye and assaying cell binding | Cysteine position | target positive percentage | iMFI | target positive percentage | iMFI | target positive percentage |
| IA-SLT-1A-D1::scFv2 (SEQ ID NO: 843) | none | 5% | 1,130 | 6% | 361 | 7% |
| IA-SLT-1A-Cys5-D1::scFv2 (SEQ ID NO: 1141) | 33 | 99% | 52,462 | 100% | 83,443 | 9% |
| SLT-1A-Cys5-D1::scFv2 (SEQ ID NO: 789) | 33 | 99% | 52,466 | 100% | 92,173 | 7% |
| IA-SLT-1A-Cys7-D1::scFv2 (SEQ ID NO: 793) | 45 | 98% | 39,793 | 100% | 81,658 | 7% |
| IA-SLT-1A-Cys8-D1::scFv2 (SEQ ID NO: 791) | 146 | 89% | 26,388 | 100% | 103,075 | 7% |
| IA-SLT-1A-Cys9-D1::scFv2 (SEQ ID NO: 792) | 186 | 97% | 33,677 | 100% | 60,459 | 6% |
| IA-SLT-1A-DI::linker-Cys1::scFv2 (SEQ ID NO: 804) | linker | 97% | 37,627 | 100% | 101,105 | 6% |
| IA-SLT-1A-DI::scFv2-linker-Cys1 (SEQ ID NO: 808) | linker | 99% | 64,287 | 100% | 131,920 | 6% |

TABLE 6-continued

Exemplary, Cargo-Linked Cell-Targeting Molecules Exhibited Binding to Target Positive Cells at Cell-Targeting Molecule Concentrations of 200 nM

| | | target positive Cell Line C | | target positive Cell Line G | | target negative Cell Line H |
|---|---|---|---|---|---|---|
| Molecule Tested by linking to dye and assaying cell binding | Cysteine position | target positive percentage | iMFI | target positive percentage | iMFI | target positive percentage |
| IA-SLT-1A-DI::scFv2-Cys1 (SEQ ID NO: 813) | scFv-Cys1 | 90% | 18,634 | 100% | 35,528 | 5% |
| anti-target 2 mAb | N/A | 98% | 48,505 | 100% | 156,783 | 2% |

The results in Table 6 demonstrated that exemplary, cargo-linked cell-targeting molecules bound to target positive cells and labeled them with their dye-cargos. However, the control protein IA-SLT-1A-D1::scFv2 (SEQ ID NO:843), which lacks any free cysteine residue, was not capable of labeling cells after being subjected to the same dye-conjugation procedure (Table 6). The exemplary, cargo-linked cell-targeting molecules did not label appreciable numbers of target negative cells (Table 6).

In addition, the cell-binding results summarized in Table 6 indicate that some cargo and cell-targeting molecule pairs were not as successful as others. For example, the samples which resulted in lower MFI values and iMFI for target positive cell lines suggest those samples had less efficient maleimide-cysteine conjugation reactions and/or lower effective cell binding properties than other samples tested.

The results of the FACS cell-binding assay measurements for cells incubated with 200 nM of cell-targeting molecule or antibody are shown in histogram overlays in FIGS. 9-11. FIGS. 9-11 show cell binding assay results for two, different, exemplary, cargo-linked cell-targeting molecules (SEQ ID NOs: 789 and 1141) which each comprise the same cysteine residue (Cys 5) linked to the same dye cargo. These two molecules differ only in that one has been rendered catalytically impaired by the amino acid residue substitution E167D in the Shiga toxin effector polypeptide component. The results shown in FIGS. 9-11 demonstrate the cell binding abilities of two, cargo-linked cell-targeted molecules of the present invention to different cell-types.

These FACS results show that exemplary, cell-targeting molecules SLT-1A-Cys5-D1::scFv2 (SEQ ID NO:789) and IA-SLT-1A-Cys5-D1::scFv2 (SEQ ID NO:1141) bind target positive cells after conjugation to an ALEXA FLUOR dye cargo (Table 6; FIGS. 9-11). Similar results is observed for other exemplary, cargo-linked cell-targeting molecules of the present invention after conjugation to an ALEXA FLUOR dye cargo, such as, e.g., cell-targeting molecules comprising or consisting of any one of SEQ ID NOs: 791, 792, 804, 808, 813, 793, and 1141 conjugated to ALEXA-488 or ALEXA-555.

B. Testing Cargo-Linked Cell-Targeting Molecules for Cell Internalization of their Cargos Exemplary, cargo-linked cell-targeting molecules were tested for cellular internalization using routine microscopy-based fluorescent techniques known to the skilled worker (see e.g. WO 2014/164680; WO 2015/138452; US20150259428). The behavior and localization of a fluorescent molecule administered to a cell(s) may be observed using fluorescent microscopy. To examine cellular internalization of the exemplary, cell-targeting molecules of the present invention, a fluorescence microscopy-based assay was used to observe the localization of cargo-linked cell-targeting molecules after administration to cells. The molecules tested in this section were an active or inactive version of a scFv2 targeted molecule (SLT-1A-Cys5-D1::scFv2 (SEQ ID NO:789) and IA-SLT-1A-Cys5-D1::scFv2 (SEQ ID NO:1141)), which comprised the Shiga toxin effector polypeptide of either SLT-1A-Cys5-D1 (SEQ ID NO:29) or IA-SLT-1A-Cys5-D1 variant 2 (SEQ ID NO:1101) conjugated to an ALEXA FLUOR dye, such as, ALEXA-488 or ALEXA-555.

In this cell-internalization assay, approximately 500,000 cells per sample were incubated at 37° C. for 1 hour in media containing 200 nM of an exemplary, dye-linked, cell-targeting molecule, a cocktail of protease inhibitors, and human BD Fc Block™. The cell samples were then washed and fixed with BD Cytofix/Cytoperm™ (BD Biosciences, San Jose, Calif., U.S.). Then the cell samples were re-suspended in PBS and spread on poly-L-lysine coated glass slides. For each slide, a coverslip was mounted using a 4',6-diamidino-2-phenylindole (DAPI)-containing VECTASHIELD® solution (catalog #NC9524612, Fisher Scientific, Waltham, Mass., U.S.), and the slides were viewed using fluorescent microscopy.

FIGS. 12-14 show some of the cell internalization results from this assay, specifically involving SLT-1A-Cys5-D1::scFv2-ALEXA-555 and IA-SLT-1A-Cys5-D1::scFv2-ALEXA-555 observed using target positive cell lines (C and G) and a target negative cell line (H). FIGS. 12-14 show merged images of two different fluorophore measurements, one of DAPI shown in blue and one for ALEXA-555 shown in red.

Both ALEXA-488 and ALEXA-555 conjugated cell-targeting molecules produced similar qualitative results, though the ALEXA-555 signal appeared more intense than the ALEXA-488 signal. The results from this cell internalization assay, some of which are shown in FIGS. 12-14, were that SLT-1A-Cys5-D1::scFv2_ALEXA-555, IA-SLT-1A-Cys5-D1::scFv2_ALEXA-555, SLT-1A-Cys5-D1::scFv2_ALEXA-488, and IA-SLT-1A-Cys5-D1::scFv2_ALEXA-488 each bound to and entered target positive cells within one hour or less (FIGS. 12-14).

C. Testing Cell-Targeting Molecules for Conjugation Using a Size Shift

Cargo-linked cell-targeting molecule samples were analyzed by SDS-PAGE in attempt to observe conjugates having a greater mass than unconjugated molecules.

FIG. 15 shows the results of the SDS-PAGE analysis of samples of SLT-1A-Cys5-D1::scFv2 (SEQ ID NO:789) before and after being linked to the cargo ALEXA-488 or ALEXA-555. The results in FIG. 15 showed a change in the mass of the target band, as expected after the conjugation to the 1,000 Dalton dye molecule. The SDS-PAGE analysis shows relatively pure samples of exemplary, cargo-linked, cell-targeting molecules of the present invention wherein the majority of protein species present are conjugated to a dye-cargo (FIG. 15).

D. Testing Cargo-Linked Cell-Targeting Molecules for Retention of Cytotoxicity

Exemplary, cargo-linked cell-targeting molecules were tested for the Shiga toxin A Subunit function of cell-targeted cytotoxicity, and by inference catalytic activity, inhibition of eukaryotic ribosome function, and self-directing subcellular routing to the cytosol. The cytotoxicity assay was performed as described in Example 1 and Example 2. Table 7 and FIG. 16 show the result of cell-kill assays for exemplary, cargo-linked cell-targeting molecules of the present invention. Unlike in Examples 1-2, the cytotoxicity of samples of cargo-linked cell targeting molecules was compared to the cytotoxicity of samples of the same cell-targeting molecules lacking any conjugated cargo.

TABLE 7

Exemplary, Cargo-Linked Cell-Targeting Molecules Exhibited Potent and Specific Cytotoxicity to Target Positive Cells

| Molecule Tested | SLT-1A Cysteine position | Cargo | target positive cells: Cell Line C $IC_{50}$ (ng/mL) | target positive cells: Cell Line G $IC_{50}$ (ng/mL) | target negative: Cell Line H $IC_{50}$ (ng/mL) |
|---|---|---|---|---|---|
| SLT-1A-D1::scFv2 (SEQ ID NO: 838) | none | none | 1.11 | 22 | >10,000 |
| SLT-1A-Cys5-D1::scFv2 (SEQ ID NO: 789) | 33 | none | 0.67 | 12 | >10,000 |
| SLT-1A-Cys5-D1:: scFv2_ALEXA-488 | 33 | ALEXA488 | 1.32 | 48 | >10,000 |
| SLT-1A-Cys5-D1:: scFv2_ALEXA-555 | 33 | ALEXA555 | 1.93 | 71 | >10,000 |

The results of the cytotoxicity assay shown in FIG. 16 and Table 7 demonstrate that cargo-linked cell-targeting molecules of this Example retained potent and specific cytotoxicity to target positive cells. The dye-linked cell-targeting molecules exhibited a cytotoxicity within 6-fold of their corresponding, unconjugated cell-targeting molecule and similar to the cytotoxicity of a related cell-targeting molecule that contained no free cysteine residue (Table 7).

The results of the experiments in Examples 4-5 demonstrated that a cargo molecule can be conjugated to a free cysteine residue of a cell-targeting molecule of the present invention such that a useful level of (1) the cell-targeting, target binding function of the binding region component is present, (2) cargo molecule delivery to the interior of a target positive cell, and/or (3) the cytotoxic function of the Shiga toxin A Subunit effector polypeptide component is present.

Example 6. Exemplary, Shiga Toxin Effector Polypeptides of the Present Invention Comprising a Unique Lysine Residue for Site-Specific Conjugation This example describes the creation of various scaffolds comprising Shiga toxin effector polypeptides, each comprising one, unique, lysine residue (SLT-1A-Lys(p)-variant), where Lys(p) represents a lysine residue at a unique position) were created and tested as components of exemplary cell-targeting molecules of the present invention. All other lysine residues were removed from the Shiga toxin effector polypeptides as genetically encoded substitutions which did not change the overall number of amino acid residues in the polypeptide. Exemplary, cell-targeting molecules of the present invention (e.g. SLT-1A-Lys(p)::scFv(n)) were created using these Shiga toxin effector polypeptides.

The parental, Shiga toxin effector polypeptide of this Example is the A Subunit of Shiga-like toxin 1 (SEQ ID NO:1). Using standard techniques, the parental, Shiga toxin effector polypeptide are used to make various Shiga toxin effector polypeptides, each having one unique lysine residue (see e.g. Table 8). Cell-targeting molecules (see e.g. SEQ ID NOs: 818-823) comprising Shiga toxin effector polypeptides (see e.g. SEQ ID NOs: 197,198, 200-202, and 205) having exactly one of the unique lysine residues described in Table 8 were made using standard techniques and tested for retention of Shiga toxin A Subunit functions as described in Example 1.

TABLE 8

Shiga Toxin Effector Polypeptides Engineered to have Unique Lysine Residues

| Exemplary, Shiga Toxin Effector Polypeptide | Unique Lysine Residue | Sequence Variants (Shiga Toxin A Subunit-Lys(p)-variant) |
|---|---|---|
| SLT-1A-Lys1 | K1 | SEQ ID NOs: 125-128, 134-137, 143-146, 152-155, 161-164, 170-173, 179-182, 188-191, 197-200, 206-209, 215-218, and 224-227 |
| SLT-1A-Lys2 | K11 | SEQ ID NOs: 129-133, 138-142, 147-151, 156-160, 165-169, 174-178, 183-187, 192-196, 201-205, 210-214, 219-223, and 228-232 |

Exemplary, cell-targeting molecules of the present invention were tested for retention of Shiga toxin A Subunit functions as described in Example 1 after removal of an endogenous lysine residue from their Shiga toxin effector polypeptide components. The Shiga toxin A Subunit functions analyzed were: inhibition of eukaryotic ribosome function, cytotoxicity, and by inference self-directing subcellular routing to the cytosol.

The potency and specificity of cytotoxic activities of exemplary, cell-targeting molecules of this Example, which each comprised a Shiga toxin effector polypeptide SLT-1A-Lys(p), were determined using a tissue culture cell-based cytotoxicity assay known to the skilled worker, mainly to assess the functions of their Shiga toxin effector polypeptide components. The cytotoxicities of exemplary, cell-targeting molecules were determined using cells expressing, at a cellular surface, significant amounts of the appropriate, extracellular target biomolecule, such as, a target of the binding region scFv4. The cells used in this Example were immortalized, human tumor cells available from the ATCC (Manassas Va., U.S.), National Cancer Institute of the U.S. (Frederick, Md., U.S.), and/or DSZM (Braunschweig, DE), such as HCC-1954, MDA-MB-231, Daudi, and U-266 cells, or more simply cell-lines A, B, G, and I, respectively. Certain cell-targeting molecules were tested using cell-kill assays involving both target biomolecule positive and target biomolecule negative cells with respect to the target biomolecule of each cell-targeting molecule's binding region.

The cytotoxicity assays were performed as follows. Certain, human tumor cell-line cells were plated (typically at $2\times10^3$ cells per well for adherent cells, plated the day prior to cell-targeting molecule addition, or $7.5\times10^3$ cells per well for suspension cells, plated the same day as cell-targeting molecule addition) in 20 µL cell culture medium in 384-well plates. A series of 10-fold dilutions of the molecules to be tested was prepared in an appropriate buffer, and 5 µL of the dilutions or buffer control were added to the plated cells. Control wells containing only cell culture medium were used for baseline correction. The cell samples were incubated with the cell-targeting molecule or just buffer for 3 or 5 days at 37° C. and in an atmosphere of 5% carbon dioxide ($CO_2$). The total cell survival or percent viability was determined using a luminescent readout using the CellTiter-Glo® Luminescent Cell Viability Assay or RealTime-Glo® MT Cell Viability Assay (Promega Corp., Madison, Wis., U.S.) according to the manufacturer's instructions.

The Percent Viability of experimental wells was calculated using the following equation: (Test RLU−Average Media RLU)÷(Average Cells RLU−Average Media RLU)×100. The logarithm of the cell-targeting molecule protein concentration versus Percent Viability was plotted in Prism (GraphPad Prism, San Diego, Calif., U.S.) and log (inhibitor) versus response (3 parameter) analysis or and log (inhibitor) versus normalized response analysis were used to determine the half-maximal cytotoxic concentration ($CD_{50}$) value for the tested molecule. The $CD_{50}$ value(s) for each molecule tested were calculated, when possible, and shown in Table 9. When $CD_{50}$ values could not be calculated based on the shape of the curve over the concentrations tested, then a maximum $CD_{50}$ value was noted as being beyond the maximum tested value, e.g., greater than 20,000 nanogram/milliliter (">20,000 ng/mL"), for samples which did not kill 50% of the cells at the highest, tested, sample concentration, e.g., 100 or 200 nanomolar (nM). In some experiments, biomolecule target negative cells treated with the maximum concentration of the cell-targeting molecule did not show any change in viability as compared to a buffer only control. The $CD_{50}$ values for exemplary, cell-targeting molecules are shown in Table 9 and associated cell-kill assay data is shown in FIGS. 17-18.

TABLE 9

Cytotoxic Activities of Exemplary, Cell-Targeting Molecules

| Molecule tested | SLT-1A lysine position | Cell-type tested (target positive or negative) | Cytotoxicity $CD_{50}$ (ng/mL) | Cell-type tested (target positive or negative) | Cytotoxicity $CD_{50}$ (ng/mL) |
|---|---|---|---|---|---|
| SLT-1A-Lysl-D3-variant-1::scFv4 SEQ ID NO: 818 | K1 | Cell Line A (positive) | 1.61 | Cell Line G (negative) | >20,000 |
| SLT-1A-Lysl-D3-variant-2::scFv4 SEQ ID NO: 819 | K1 | Cell Line A (positive) | 1.89 | Cell Line G (negative) | >20,000 |
| SLT-1A-Lysl-D3-variant-4::scFv4 SEQ ID NO: 820 | K1 | Cell Line A (positive) | 2.99 | Cell Line G (negative) | >20,000 |
| SLT-1A-Lys2-D3-variant-1::scFv4 SEQ ID NO: 821 | K11 | Cell Line A (positive) | 0.58 | Cell Line G (negative) | >20,000 |
| SLT-1A-Lys2-D3-variant-2::scFv4 SEQ ID NO: 822 | K11 | Cell Line A (positive) | 2.40 | Cell Line G (negative) | >20,000 |
| SLT-1A-Lys2-D3-variant-5::scFv4 SEQ ID NO: 823 | K11 | Cell Line A (positive) | 2.99 | Cell Line G (negative) | >20,000 |
| SLT-1A-D3::scFv4 control SEQ ID NO: 828 | K1/K11 | Cell Line A (positive) | 1.22 | Cell Line G (negative) | >20,000 |

The molecules tested for cytotoxic activity in this Example included cell-targeting molecules comprising or consisting of SLT-1A-Lys1-D3-variant-1::scFv4 (SEQ ID NO:818), SLT-1A-Lys1-D3-variant-2::scFv4 (SEQ ID NO:819), SLT-1A-Lys1-D3-variant4::scFv4 (SEQ ID NO:820), SLT-1A-Lys2-D3-variant-1::scFv4 (SEQ ID NO:821), SLT-1A-Lys2-D3-variant2::scFv4 (SEQ ID NO:822), and SLT-1A-Lys2-D3-variant-5::scFv4 (SEQ ID NO:823). The exemplary cell-targeting molecules of the present invention represented by SEQ ID NOs: 818-823 were each cytotoxic to target positive cells, commonly exhibiting $CD_{50}$ values less than 3 ng/mL, depending on the cell-line tested. The cytotoxicities of the Shiga toxin effector polypeptides (SEQ ID NOs: 197,198, 200-202, and 205) tested as a component of a cell-targeting molecule were comparable to the cytotoxicities of a related, Shiga toxin effector polypeptide having two or more endogenous lysine residues (see e.g. cytotoxicities measured for SLT-1A-D3::scFv4 (SEQ ID NO:828) in Table 9 and FIGS. 17-18).

Similar to the use of cysteine residues in Examples 1-5, a unique lysine residue may be used for site-specific attachment of other molecules using conjugation chemical reactions known to the skilled worker. Commonly, two molecules are linked via an acylation of the functional group of the lysine.

Example 7. Constructing Exemplary, Shiga Toxin Effector Polypeptides of the Present Invention by Removing Lysine Residues Via Amino Acid Residue Substitution This example describes the creation of various scaffolds comprising Shiga toxin effector polypeptides, each comprising one, unique, lysine residue. All other lysine residues are removed from the Shiga toxin effector polypeptides as genetically encoded substitutions which did not change the overall number of amino acid residues in the polypeptide. Exemplary, cell-targeting molecules of the present invention (e.g. scFv(n)::SLT-1A-Lys(p) and SLT-1A-Lys(p)::scFv(n), where 'p' numbers the unique lysine residue) are created using these Shiga toxin effector polypeptides.

The parental, Shiga toxin effector polypeptide of this Example is the A Subunit of Shiga toxin (SEQ ID NO:2), Shiga-like toxin 1 (SEQ ID NO:1), and Shiga-like toxin 2 (SLT-2A) (SEQ ID NO:3). Using standard techniques, the parental, Shiga toxin effector polypeptide is used to make various Shiga toxin effector polypeptides, each having one unique lysine residue (see e.g. Table 10). Cell-targeting molecules (see e.g. SEQ ID NOs: 773-783) comprising Shiga toxin effector polypeptides (see e.g. SEQ ID NOs: 125-232, 1109-1140) having exactly one of the unique lysine residues described in Table 10 are made using standard techniques and tested for retention of Shiga toxin A Subunit function as in Example 1.

TABLE 10

Shiga Toxin Effector Polypeptides Engineered to have Unique Lysine Residues

| Exemplary, Shiga Toxin Effector Polypeptide | Unique Lysine Residue | Sequence Variants (Shiga Toxin A Subunit-Lys(p)-variant) |
|---|---|---|
| StxA-Lys1 | K1 | SEQ ID NOs: 1109 and 1112 |
| StxA-Lys2 | K11 | SEQ ID NOs: 1110 and 1113-1114 |
| StxA-Lys3 | K274 | SEQ ID NOs: 1111 and 1115-1116 |
| SLT-1A-Lys1 | K1 | SEQ ID NOs: 1117 and 1120 |
| SLT-1A-Lys2 | K11 | SEQ ID NOs: 1118 and 1121-1122 |
| SLT-1A-Lys3 | K274 | SEQ ID NOs: 1119 and 1123-1124 |
| SLT-2A-Lys1 | K11 | SEQ ID NOs: 1125 and 1130 |
| SLT-2A-Lys2 | K255 | SEQ ID NOs: 1126, 1131, 1138 and 1135 |
| SLT-2A-Lys3 | K257 | SEQ ID NOs: 1127, 1132, 1136, 1139 |
| SLT-2A-Lys4 | K270 | SEQ ID NOs: 1128, 1133, 1137 and 1140 |
| SLT-2A-Lys5 | K288 | SEQ ID NOs: 1129 and 1134 |

Exemplary, cell-targeting molecules of the present invention are tested for retention of Shiga toxin A Subunit functions after removal of endogenous lysine residues from their Shiga toxin effector polypeptide components. The Shiga toxin A Subunit functions analyzed are: catalytic activity, inhibition of eukaryotic ribosome function, cytotoxicity, and by inference self-directing subcellular routing to the cytosol.

The catalytic activities of Shiga toxin effector polypeptide components of exemplary, cell-targeting molecules of this Example are tested using a ribosome inhibition assay. The ribosome inactivation activities of all the Shiga toxin effector polypeptides SLT-1A-Lys(p) tested in the context of a cell-targeting molecule are equivalent to the catalytic activity of similarly de-immunized Shiga toxin effector polypeptides comprising all the natively occurring lysine residues and/or wild-type, Shiga toxin A1 fragments (amino acids 1-251 of SEQ ID NO:1 or SEQ ID NO:2; or amino acids 1-250 of SEQ ID NO:3).

The potency and specificity of cytotoxic activities of exemplary, cell-targeting molecules of this Example, which each comprised a Shiga toxin effector polypeptide SLT-1A-Lys(p), are determined using a tissue culture cell-based cytotoxicity assay known to the skilled worker. The exemplary cell-targeting molecules of the present invention are each cytotoxic to target positive cells, commonly exhibiting $CD_{50}$ values less than 100 nM, depending on the cell-line tested. The cytotoxicities of many of the Shiga toxin effector polypeptides tested as a component of a cell-targeting molecule are comparable to the cytotoxicities of a related, Shiga toxin effector polypeptide having two or more endogenous lysine residues.

Exemplary cell-targeting molecules of this Example are produced, purified and conjugated to another molecule via a lysine residue of the Shiga toxin effector polypeptide component of the cell-targeting molecule using routine methods known to the skilled worker, such as, e.g., wherein the other molecule comprises a succinimidyl ester-fluorescent dye or iso/isothio-cyanate-fluorescent dye. These cell-targeting molecules are tested for cell-targeting, internalization, multimerization, and/or cytotoxicity as described in Example 5. The results of cytotoxicity assays show that cargo-linked cell-targeting molecules of this Example retain potent and specific cytotoxicity to target positive cells that is comparable in potency and activity to unconjugated variants of these cell-targeting molecules. The results of the experiments in this Example demonstrate that a cargo molecule can be conjugated to a unique lysine residue of a Shiga toxin effector polypeptide component of a cell-targeting molecule of the present invention, and, furthermore, such conjugated cell-targeting molecules exhibit a useful level of cargo molecule delivery to the interior of a target positive cell and/or cytotoxicity to targeted cells.

Example 8. Constructing Exemplary, Shiga Toxin Effector Polypeptides of the Present Invention by Removing Lysine Residues Via Amino Acid Residue Substitution This example describes the creation of various scaffolds comprising Shiga toxin effector polypeptides, each comprising zero lysine residues. All lysine residues respectively are removed from the Shiga toxin effector polypeptides as genetically encoded substitutions which did not change the overall number of amino acid residues in the polypeptide. Exemplary, cell-targeting molecules of the present invention (e.g. SLT-1A-Lys(null)::scFv(n) where 'null' refers to the lack of any lysine residue in the Shiga toxin A Subunit component) are created using these Shiga toxin effector polypeptides.

The parental, Shiga toxin effector polypeptide of this Example is the A Subunit of Shiga toxin (SEQ ID NO:2), Shiga-like toxin 1 (SEQ ID NO:1), and Shiga-like toxin 2 (SLT-2A) (SEQ ID NO:3). Using standard techniques, the parental, Shiga toxin effector polypeptide is used to make various Shiga toxin effector polypeptides, each lacking any lysine residues (see e.g. Table 11). Cell-targeting molecules (see e.g. SEQ ID NOs: 773-783 and 824-827) comprising Shiga toxin effector polypeptides (see e.g. SEQ ID NOs: 233-720) are made using standard techniques and tested for retention of Shiga toxin A Subunit function as in Examples 1 and 6.

TABLE 11

| Shiga Toxin Effector Polypeptides Engineered to have Unique Lysine Residues | | |
|---|---|---|
| Exemplary, Shiga Toxin Effector Polypeptide | Lysine Null | Sequence Variants (Shiga Toxin A Subunit-Lys(null)-variant) |
| SLT-1A-Lys(null) | no lysines | SEQ ID NOs: 233-252, 314-333, 477-496, and 558-577 |
| SLT-1A-Lys(null)-FR | no lysines | SEQ ID NOs: 253-272, 334-353, 497-516, and 578-597 |
| SLT-1A-Ly s(null)-D1 | no lysines | SEQ ID NOs: 273-292, 354-373, 517-536, and 598-617 |
| SLT-1A-Lys(null)-D2 | no lysines | SEQ ID NOs: 293-313, 374-394, 537-557, and 618-638 |
| SLT-1A-Lys(null)-D3 | no lysines | SEQ ID NOs: 395-414, 436-455, 639-658, and 680-699 |
| SLT-1A-Lys(null)-D4 | no lysines | SEQ ID NOs: 415-435, 456-476, 659-679, and 700-720 |

Exemplary, cell-targeting molecules of the present invention were tested for retention of Shiga toxin A Subunit functions after removal of all lysine residues from their Shiga toxin effector polypeptide components. The Shiga toxin A Subunit functions analyzed are: catalytic activity, inhibition of eukaryotic ribosome function, cytotoxicity, and by inference self-directing subcellular routing to the cytosol.

The catalytic activities of Shiga toxin effector polypeptide components of exemplary, cell-targeting molecules of this Example are tested using a ribosome inhibition assay. The ribosome inactivation activities of Shiga toxin effector polypeptides StxA-Lys(null) variants, SLT-1A-Lys(null) variants, and SLT-2A-Lys(null) variants are tested in the context of a cell-targeting molecule and found to be equivalent to the catalytic activity of similarly de-immunized Shiga toxin effector polypeptides comprising all the endogenous, natively occurring lysine residues and/or wild-type, Shiga toxin A1 fragments (such as, e.g., amino acids 1-251 of SEQ ID NO:1 or SEQ ID NO:2; or amino acids 1-250 of SEQ ID NO:3).

The potency and specificity of cytotoxic activities of exemplary, cell-targeting molecules of this Example, which each comprised a Shiga toxin effector polypeptide StxA-Lys (null), SLT-1A-Lys(null), or SLT-2A-Lys(null) are determined using a tissue culture cell-based cytotoxicity assay known to the skilled worker.

Exemplary, cell-targeting molecules of the present invention were tested for retention of Shiga toxin A Subunit functions as described in Example 6 after removal of all endogenous lysine residues from their Shiga toxin effector polypeptide components. The Shiga toxin A Subunit functions analyzed were: inhibition of eukaryotic ribosome function, cytotoxicity, and by inference self-directing subcellular routing to the cytosol. The potency and specificity of cytotoxic activities of exemplary, cell-targeting molecules of this Example, which each comprised a Shiga toxin effector polypeptide SLT-1A-Lys(null) variant as described in Table 11, were determined using a tissue culture cell-based cytotoxicity assay known to the skilled worker, mainly to assess the functions of their Shiga toxin effector polypeptide components. The $CD_{50}$ values for exemplary, cell-targeting molecules are shown in Table 12 and associated cell-kill assay data is shown in FIGS. 17-19.

TABLE 12

| Cytotoxic Activities of Exemplary, Cell-Targeting Molecules | | | | | |
|---|---|---|---|---|---|
| Molecule tested | SLT-1A Lysine position | Cell-type tested (target positive or negative) | Cytotoxicity $CD_{50}$ (ng/mL) | Cell-type tested (target positive or negative) | Cytotoxicity $CD_{50}$ (ng/mL) |
| SLT-1A-Lys(null)-D3-variant-21::scFv4 SEQ ID NO: 824 | none | Cell Line A (positive) | 1.62 | Cell Line G (negative) | >20,000 |
| SLT-1A-Lys(null)-varaint-27::scFv4 SEQ ID NO: 825 | none | Cell Line A (positive) | 2.4 | Cell Line G (negative) | >20,000 |
| SLT-1A-Lys(null)-D3-variant-40::scFv4 SEQ ID NO: 826 | none | Cell Line A (positive) | 8.81 | Cell Line G (negative) | >20,000 |
| SLT-1A-Lys(null)-D4-variant-42::scFv4 SEQ ID NO: 827 | none | Cell Line A (positive) | 1.04 | Cell Line I (negative) | >20,000 |
| SLT-1A-D3::scFv4 control SEQ ID NO: 828 | K1/K11 | Cell Line A (positive) | 1.01 | Cell Line G (negative) | >20,000 |
| SLT-1A-D5::scFv4 control SEQ ID NO: 829 | K1/K11 | Cell Line A (positive) | 1.36 | | |

The exemplary cell-targeting molecules of the present invention (SEQ ID NOs: 824-827) are each cytotoxic to target positive cells, commonly exhibiting $CD_{50}$ values less than 10 ng/mL, depending on the cell-line tested (see Table 12 and FIGS. 17-19). The cytotoxicities of many of the Shiga toxin effector polypeptides (SEQ ID NOs: 639,645, 658, and 679) tested as a component of a cell-targeting molecule were comparable to the cytotoxicities of a related, Shiga toxin effector polypeptide having two or more endogenous lysine residues (see e.g. the cytotoxicities measured for SLT-1A-D3::scFv4 (SEQ ID NO:828) and SLT-1A-D5::scFv4 (SEQ ID NO:829) in Table 12 and FIG. 19).

Exemplary cell-targeting molecules of this Example are produced, purified and conjugated to another molecule via a lysine residue of the cell-targeting molecule using routine methods known to the skilled worker, such as, e.g., wherein the other molecule comprises a succinimidyl ester-fluorescent dye or iso/isothio-cyanate-fluorescent dye. These cell-targeting molecules are tested for cell-targeting, internalization, multimerization, and/or cytotoxicity as described in Example 5. The results of cytotoxicity assays show that cargo-linked cell-targeting molecules of this Example retain potent and specific cytotoxicity to target positive cells that is comparable in potency and activity to unconjugated variants of these cell-targeting molecules.

The results of the experiments in this Example demonstrate that a cargo molecule can be conjugated to a free lysine residue of a component of a cell-targeting molecule of the present invention comprising only those Shiga toxin effector polypeptide(s) lacking lysine residues, and, furthermore, such conjugated cell-targeting molecules exhibit a useful level of cargo molecule delivery to the interior of a target positive cell and/or cytotoxicity to targeted cells.

Example 9. Exemplary, Cell-Targeting Molecules of the Present Invention Comprising a Lysine or Free Cysteine for Site-Specific Conjugation Outside the Toxin Effector Region This example describes the creation of various scaffolds comprising Shiga toxin effector polypeptides, each lacking either any cysteine residue or any lysine residue. Many of these scaffolds involved a linker or extension consisting of a peptide or polypeptide fused directly to a Shiga toxin A Subunit effector polypeptide lacking any cysteine or lysine residue. As used in this example, a "linker" represents a structure in a cell-targeting molecule which links a Shiga toxin effector polypeptide to a cell-targeting binding region capable of binding an extracellular target biomolecule with high affinity wherein the linker is neither part of the Shiga toxin effector polypeptide region structure nor part of the cell-targeting binding region structure.

In this Example, Shiga toxin A Subunit effector polypeptides lacking any cysteine and/or lysine residue (such as, e.g., SLT-1A-Lys(null) variants described in Example 8) were created and fused to cell-targeting moieties. This allows for the creation of cell-targeting molecules comprising such a Shiga toxin A Subunit effector polypeptide wherein there is a unique lysine or free cysteine present outside of the toxin effector region. The removal of all cysteine or lysine residues from the toxin effector region prevents other conjugation sites from being available when certain conjugation reactions are performed on such cell-targeting molecules. A free cysteine or unique lysine residue outside the Shiga toxin component of a cell-targeting molecule of the present invention may be used for site-specific attachment of other molecules using conjugation chemical reactions known to the skilled worker.

Using routine techniques known to the skilled worker, all cysteine and/or lysine residues are removed from Shiga toxin effector polypeptides by introducing one or more amino acid residue substitutions as genetically encoded substitutions which did not change the overall number of amino acid residues in the polypeptide. The parental, Shiga toxin effector polypeptide of this Example is the A Subunit of Shiga toxin (SEQ ID NO:2), Shiga-like toxin 1 (SEQ ID NO:1), and Shiga-like toxin 2 (SLT-2A) (SEQ ID NO:3). The parental, Shiga toxin effector polypeptide is used to make various Shiga toxin effector polypeptides (see e.g. Table 11). Cell-targeting molecules (see e.g. SEQ ID NOs: 773-783 and 824-827) comprising such 'null' Shiga toxin A Subunit effector polypeptides (see e.g. SEQ ID NOs: 233-756) are made using standard techniques and tested for retention of Shiga toxin A Subunit function as in Examples 1 and 6.

Using standard techniques, Shiga toxin effector polypeptides of this Example were fused to linkers comprising exactly one cysteine or lysine residue to create exemplary Shiga toxin A Subunit effector polypeptide scaffolds of the present invention (also referred to herein as "Shiga toxin effector scaffolds"). Whichever amino acid residue was absent from the Shiga toxin effector polypeptide (e.g. cysteine or lysine) was included at a single unique position in the Shiga toxin effector scaffold.

Exemplary Shiga toxin A Subunit effector polypeptide scaffolds of the present invention, each comprising one or more lysine and/or free cysteine residues outside any toxin effector region, were created and tested in the context of a cell-targeting molecule for retention of Shiga toxin A Subunit function as in Examples 1 and 6. In this Example, each exemplary Shiga toxin effector scaffold of the present invention that was tested comprised additional proteinaceous structure outside of the Shiga toxin effector polypeptide region (see Tables 13).

TABLE 13

Exemplary, Shiga Toxin Effector Polypeptide Scaffolds of the Present Invention Comprising Only One Lysine Residue for Conjugation

| Scaffold | Toxin Effector Null for | Residue Available for Conjugation | Shiga Toxin A Subunit Scaffold Sequence |
|---|---|---|---|
| SLT-1A-Lys(null) scaffold variant 1 | cysteine | cysteine at position 257 | SEQ ID NO: 762 |
| SLT-1A-Lys(null) scaffold variant 2 | cysteine | cysteine at position 257 | SEQ ID NO: 763 |
| SLT-1A-Lys(null) scaffold variant 1 | lysine and cysteine | lysine at position 255 | SEQ ID NO: 764 |
| SLT-1A-Lys(null) scaffold variant 2 | lysine and cysteine | lysine at position 255 | SEQ ID NO: 765 |
| SLT-1A-Lys(null) scaffold variant 3 | lysine and cysteine | lysine at position 255 | SEQ ID NO: 766 |
| SLT-1A-Lys(null) scaffold variant 4 | lysine and cysteine | lysine at position 255 | SEQ ID NO: 767 |

Using standard techniques, exemplary, cell-targeting molecules of the present invention (named e.g. SLT-1A-Lys(null)::scFv(n) or SLT-1A-Cys(null)::scFv(n)), each comprising one or more lysine and/or free cysteine residues outside any toxin effector region, were created using the 'null' Shiga toxin effector polypeptides (e.g. SLT-1A-Lys (null) or SLT-1A-Cys(null), where 'null' represents the lack of any lysine or cysteine residue, respectively). Some of the exemplary cell-targeting molecules of this Example comprises an exemplary, Shiga toxin effector polypeptide scaffolds of this Example (selected from SEQ ID NOs: 762-767, see also Table 13).

Cell-targeting molecules (see e.g. SEQ ID NOs: 773-783 and 824-827) based on such 'null' Shiga toxin A Subunit effector polypeptides (SEQ ID NOs: 233-756) were made using standard techniques and tested for retention of Shiga toxin A Subunit function as in Examples 1 and 6. In this Example, each cell-targeting molecule that was tested comprised a cell-targeting, immunoglobulin-type, binding region comprising a polypeptide capable of binding to an extracellular target biomolecule with high-affinity (see Tables 13-15). Protein expression and purification of these cell-targeting molecules was performed using standard techniques known to the skilled worker and/or as previously described (see e.g. WO 2014/164680, WO 2014/164693, WO 2015/138435, WO 2015/138452, WO 2015/191764, and WO 2016/126950), such as using Capto™-L (GE Healthcare, Marlborough, Mass., U.S.).

TABLE 14

Exemplary Cell-Targeting Molecule Components of the Present Invention Comprising an Engineered, Free Cysteine Available for Conjugation

| Cell-Targeting Molecule Component | Conjugation site location | Exemplary, Cell-Targeting Molecules with Component |
|---|---|---|
| linker-Cys1 (SEQ ID NO: 757) | between Binding Region and Toxin Effector Region | SEQ ID NOs: 803-806 |
| linker-Cys2 (SEQ ID NO: 758) | between Binding Region and Toxin Effector Region | |
| linker-Cys3 (SEQ ID NO: 759) | between Binding Region and Toxin Effector Region | |
| linker-Cys4 (SEQ ID NO: 760) | between Binding Region and Toxin Effector Region | |
| scFv-linker-Cys1 (SEQ ID NO: 769) | between the scFv's heavy and light variable regions | SEQ ID NOs: 807-808 |
| scFv-linker-Cys2 (SEQ ID NO: 770) | between the scFv's heavy and light variable regions | SEQ ID NOs: 809-811 |
| scFv-linker-Cys3 (SEQ ID NO: 771) | between the scFv's heavy and light variable regions | |
| scFv-linker-Cys4 (SEQ ID NO: 772) | between the scFv's heavy and light variable regions | |
| scFv(n)-Cys-C2 | penultimate C-terminal residue of Binding Region | SEQ ID NOs: 812-815 |
| $V_H$H(n)-Cys-C2 | penultimate C-terminal residue of Binding Region | SEQ ID NOs: 816-817 |

The cytotoxicities of exemplary, cell-targeting molecules were determined using cells expressing, at a cellular surface, significant amounts of the appropriate, extracellular target biomolecule. Using the cytotoxicity assay, the $CD_{50}$ value(s) for each molecule tested were calculated (and reported in Table 15), and associated cell-kill assay data is shown in FIGS. 4, and 17-18. When $CD_{50}$ values could not be calculated based on the shape of the curve over the concentrations tested, then a maximum $CD_{50}$ value was noted as being beyond the maximum tested value, e.g., greater than 100 nM (">100 nM"), for samples which did not kill 50% of the cells at the highest, tested, sample concentration, e.g., 100 nM. Cytotoxic activities were measured for exemplary, cell-targeting molecules of the present invention which each comprised one of the following components: a SLT-1A-Lys (null) scaffold variant, linker-Cys(p), scFv(n)-linker-Cys(p), or scFv(n)-Cys(p). These experiments included measuring the cytotoxic activities of the exemplary, cell-targeting molecules of the present invention comprising or consisting of SEQ ID NOs: 803, 807, 812, and 824-826. The exemplary, cell-targeting molecules SLT-1A-Lys(null)-D3-variant-21::scFv4 (SEQ ID NO:824), SLT-1A-Lys(null)-D3-variant-27::scFv4 (SEQ ID NO:825), and SLT-1A-Lys(null)-D3-variant-40::scFv4 (SEQ ID NO:826) comprise the Shiga toxin effector scaffolds SEQ ID NOs: 764, 765, and 766, respectively (see e.g. Table 13).

TABLE 15

Cytotoxic Activities of Exemplary, Cell-Targeting Molecules

| Molecule Tested | Free Cysteine location | Cell-type tested (target positive or negative) | Cytotoxicity $CD_{50}$ (nM) | Cell-type tested (target positive or negative) | Cytotoxicity $CD_{50}$ (nM) |
|---|---|---|---|---|---|
| SLT-1A-D1::linker-Cys1::scFv2 (SEQ ID NO: 803) | between Toxin Effector and Binding Region | Cell Line C (positive) | 0.0006 | Cell Line D (positive) | 0.0089 |
| SLT-1A-D1::scFv2-linker-Cys1 (SEQ ID NO: 807) | between variable domains of scFv2 | Cell Line C (positive) | 0.0038 | Cell Line D (positive) | 0.0273 |
| SLT-1A-D1::scFv2-Cys-C2 (SEQ ID NO: 812) | in variable domain of scFv2 | Cell Line C (positive) | 0.0002 | Cell Line D (positive) | 0.002 |
| SLT-1A-D1::scFv2 (SEQ ID NO: 838) | none | Cell Line C (positive) | 0.0026 | Cell Line D (positive) | 0.0073 |
| **Molecule Tested** | **Lysine location** | **Cell-type tested (target positive or negative)** | **Cytotoxicity $CD_{50}$ (ng/mL)** | **Cell-type tested (target positive or negative)** | **Cytotoxicity $CD_{50}$ (ng/mL)** |
| SLT-1A-Lys(null)-D3-variant-21::scFv4 (SEQ ID NO: 824) | K256 between Toxin Effector and Binding Region | Cell Line A (positive) | 1.62 | Cell Line G (negative) | >20,000 |

TABLE 15-continued

| Cytotoxic Activities of Exemplary, Cell-Targeting Molecules | | | | | |
|---|---|---|---|---|---|
| SLT-1A-Lys(null)-D3-variant-27::scFv4 (SEQ ID NO: 825) | K256 between Toxin Effector and Binding Region | Cell Line A (positive) | 2.4 | Cell Line G (negative) | >20,000 |
| SLT-1A-Lys(null)-D3-variant-40::scFv4 (SEQ ID NO: 826) | K256 between Toxin Effector and Binding Region | Cell Line A (positive) | 8.81 | Cell Line G (negative) | >20,000 |
| SLT-1A-D3::scFv4 (SEQ ID NO: 828) | K1, K11, and K256 between Toxin Effector and Binding Region | Cell Line A (positive) | 1.22 | Cell Line G (negative) | >20,000 |
| SLT-1A-D3::scFv4 (SEQ ID NO: 828) | K1, K11, and K256 between Toxin Effector and Binding Region | Cell Line A (positive) | 1.01 | Cell Line G (negative) | >20,000 |
| SLT-1A-D3::scFv4 variant 2 (SEQ ID NO: 829) | K1, K11 | Cell Line A (positive) | 1.36 | | |

Table 15 and FIG. 4 shows experimental results from examples of cell targeting molecules comprising a free, cysteine residue outside any Shiga toxin effector polypeptide component(s) (e.g., SLT-1A-D1::linker-Cys1::scFv2 (SEQ ID NO:803), SLT-1A-D1::scFv2-linker-Cys1 (SEQ ID NO:807), and SLT-1A-D1::scFv2-Cys-C2 (SEQ ID NO:812). The cytotoxic activities of SLT-1A-D1::linker-Cys1::scFv2 (SEQ ID NO:803), SLT-1A-D1::scFv2-linker-Cys1 (SEQ ID NO:807), and SLT-1A-D1::scFv2-Cys-C2 (SEQ ID NO:812) were comparable to the activity of the parental molecule SLT-1A-D1::scFv2 (SEQ ID NO:838), which lacks any cysteine residue in its Shiga toxin effector polypeptide component. The results reported in Table 15 show that the cell-targeting molecules comprising or consisting of SLT-1A-D1::linker-Cys1::scFv2, SLT-1A-D1::scFv2-linker-Cys1, and SLT-1A-D1::scFv2-Cys-C2 were all cytotoxic to target positive cells, with $CD_{50}$ values of less than 30 pM. The cytotoxicities of the Shiga toxin effector polypeptide component (SLT-1A-D1 (SEQ ID NO:831)) of these cell-targeting molecules was comparable to the cytotoxicity of the identical Shiga toxin effector polypeptide (SLT-1A-D1 (SEQ ID NO:831)) as a component of the positive control, reference molecule SLT-1A-D1::scFv2 (SEQ ID NO:837) (Table 15; FIG. 4).

Table 15 and FIGS. 17-18 show experimental results from the testing of exemplary, cell targeting molecules (SEQ ID NOs: 824-826), which each comprise a Shiga toxin effector scaffold of the present invention (SEQ ID NO: 764, 765, or 766) based on a lysine-null Shiga toxin effector polypeptide of the present invention (e.g. SLT-1A-Lys(null)-variant). Each one of these molecules SLT-1A-Lys(null)-D3-variant-21::scFv4 (SEQ ID NO:824), SLT-1A-Lys(null)-D3-variant-27::scFv4 (SEQ ID NO:825), and SLT-1A-Lys(null)-D3-variant-40::scFv4 (SEQ ID NO:826) comprises a lysine at position 256, which is outside any Shiga toxin effector polypeptide region. The cytotoxic activities of SLT-1A-Lys(null)-D3-variant-21::scFv4 (SEQ ID NO:824), SLT-1A-Lys(null)-D3-variant-27::scFv4 (SEQ ID NO:825), and SLT-1A-Lys(null)-D3-variant-40::scFv4 (SEQ ID NO:826) were comparable to the activity of the reference molecules SLT-1A-D3::scFv4 (SEQ ID NO:828) and SLT-1A-D3::scFv4 variant 2 (SEQ ID NO:829), which both comprise all the endogenous, natively occurring lysine residues present in the wild-type SLT-1A1 fragment. The results reported in Table 15 show that the cell-targeting molecules comprising or consisting of SEQ ID NO: 824, 825, or 826 were each cytotoxic to target positive cells, with $CD_{50}$ values of less than 10 ng/mL (see Table 15; FIGS. 17-18). Thus, cell-targeting molecules comprising SEQ ID NO: 764, 765, or 766 are capable, in the context of a cell-targeting molecule, of exhibiting cytotoxicity to target positive cells, with $CD_{50}$ values of less than 10 ng/mL.

Example 10. Exemplary, Shiga Toxin Effector Polypeptides of the Present Invention Comprising a Unique Selenocysteine Residue for Site-Specific Conjugation In this Example, exemplary Shiga toxin A Subunit effector polypeptides of the present invention (SLT-1A-Sec(p)-variant), where Sec(p) represents a selenocysteine residue engineered at a unique position), each comprising one ectopic selenocysteine residue, are created and tested as components of exemplary cell-targeting molecules of the present invention. The ectopic, selenocysteine residues are engineered into Shiga toxin effector polypeptides as genetically encoded substitutions which did not change the overall number of amino acid residues in the polypeptide. Exemplary, cell-targeting molecules of the present invention (e.g. SLT-1A-Sec(p)-variant::scFv(n), scFv(n)::SLT-1A-Sec(p)-variant), StxA-Sec(p)-variant::scFv(n), and scFv(n)::StxA-Sec(p)-variant) are created using these Shiga toxin effector polypeptides.

In this Example, cell-targeting molecules, each comprising a Shiga toxin A Subunit effector polypeptide having one ectopic, selenocysteine residue, are created and tested. These cell-targeting molecules each comprised a cell-targeting, immunoglobulin-type, binding region comprising a polypeptide capable of binding to an extracellular target biomolecule with high-affinity.

The parental, Shiga toxin effector polypeptide of this Example is the A1 fragment of the A Subunit of Shiga toxin (SEQ ID NO:2), Shiga-like toxin 1 (SEQ ID NO:1), and Shiga-like toxin 2 (SLT-2A) (SEQ ID NO:3), optionally comprising the substitution C241S or C242S to remove the only endogenous, cysteine residue in the parental molecule. Using standard techniques, the parental, Shiga toxin effector polypeptide is used to make various Shiga toxin effector polypeptides, each having one unique and ectopic selenocysteine residue and optionally no cysteine residues (see e.g. Table 16). Cell-targeting molecules comprising Shiga toxin effector polypeptides having exactly one of the ectopic selenocysteine residues described in Table 16 are made using standard techniques and tested as described in the Examples above. In Table 16, the code "Se-C" refers to selenocysteine.

TABLE 16

Ectopic, Selenocysteine Residues Engineered into Shiga Toxin Effector Polypeptides

| Exemplary, Shiga toxin effector polypeptides StxA-Sec(p) and SLT-1A-Sec(p) | Selenocysteine Substitution |
|---|---|
| StxA-Sec1 and SLT-1A-Sec1 | K1Se-C |
| StxA-Sec2 and SLT-1A-Sec2 | S8Se-C |
| StxA-Sec3 and SLT-1A-Sec3 | S16Se-C |
| StxA-Sec4 and SLT-1A-Sec4 | S22Se-C |
| StxA-Sec5 and SLT-1A-Sec5 | S33Se-C |
| StxA-Sec6 and SLT-1A-Sec6 | S43Se-C |
| StxA-Sec7 or SLT-1A-Sec7 (identical) | S45Se-C |
| StxA-Sec8 and SLT-1A-Sec8 | V54Se-C |
| StxA-Sec9 and SLT-1A-Sec9 | S146Se-C |
| StxA-Sec10 and SLT-1A-Sec10 | S186Se-C |

Exemplary, cell-targeting molecules of the present invention are tested for retention of Shiga toxin A Subunit functions after introduction of selenocysteine residues into their Shiga toxin effector polypeptide components. The Shiga toxin A Subunit functions analyzed are: catalytic activity, inhibition of eukaryotic ribosome function, cytotoxicity, and by inference self-directing subcellular routing to the cytosol.

The catalytic activities of Shiga toxin effector polypeptide components of exemplary, cell-targeting molecules of this Example are tested using a ribosome inhibition assay. The ribosome inactivation activities of all the Shiga toxin effector polypeptides SLT-1A-Sec(p) tested in the context of a cell-targeting molecule are equivalent to the catalytic activity of similarly de-immunized Shiga toxin effector polypeptides comprising all the natively occurring cysteine residues and/or wild-type, Shiga toxin A1 fragments (amino acids 1-251 of SEQ ID NO:1 or SEQ ID NO:2; or amino acids 1-250 of SEQ ID NO:3).

The potency and specificity of cytotoxic activities of exemplary, cell-targeting molecules of this Example, which each comprised a Shiga toxin effector polypeptide SLT-1A-Sec(p), are determined using a tissue culture cell-based cytotoxicity assay known to the skilled worker. The exemplary cell-targeting molecules of the present invention are each cytotoxic to target positive cells, commonly exhibiting $CD_{50}$ values less than 100 nM, depending on the cell-line tested. The cytotoxicities of many of the Shiga toxin effector polypeptides tested as a component of a cell-targeting molecule are comparable to the cytotoxicities of a related, Shiga toxin effector polypeptide having all its endogenous cysteine residues.

Exemplary cell-targeting molecules of this Example are produced, purified and conjugated to another molecule via a selenocysteine of the cell-targeting molecule using routine methods known to the skilled worker, such as, e.g., wherein the other molecule comprises a succinimidyl ester-fluorescent dye or iso/isothio-cyanate-fluorescent dye. These cell-targeting molecules are tested for cell-targeting, internalization, multimerization, and/or cytotoxicity as described in Example 5. The results of cytotoxicity assays show that cargo-linked cell-targeting molecules of this Example retain potent and specific cytotoxicity to target positive cells that is comparable in potency and activity to unconjugated variants of these cell-targeting molecules.

The results of the experiments in this Example demonstrate that a cargo molecule can be conjugated to a selenocysteine residue of a Shiga toxin effector polypeptide component of a cell-targeting molecule of the present invention, and, furthermore, such conjugated cell-targeting molecules exhibit a useful level of cargo molecule delivery to the interior of a target positive cell and/or cytotoxicity to targeted cells.

Example 11. Exemplary, Shiga Toxin Effector Polypeptides of the Present Invention Comprising a Unique Pyrroline-Carboxy-Lysine Residue for Site-Specific Conjugation In this Example, exemplary Shiga toxin A Subunit effector polypeptides of the present invention (SLT-1A-Pcl(p)-variant), where Pcl(p) represents a pyrroline-carboxy-lysine residue engineered at a unique position), each comprising one ectopic pyrroline-carboxy-lysine residue, are created and tested as components of exemplary cell-targeting molecules of the present invention. The ectopic, pyrroline-carboxy-lysine residues are engineered into Shiga toxin effector polypeptides as genetically encoded substitutions which did not change the overall number of amino acid residues in the polypeptide. Exemplary, cell-targeting molecules of the present invention (e.g. SLT-1A-Pcl(p)-variant::scFv(n), scFv(n)::SLT-1A-Pcl(p)-variant), StxA-Pcl(p)-variant::scFv(n), and scFv(n)::StxA-Pcl(p)-variant) are created using these Shiga toxin effector polypeptides.

In this Example, cell-targeting molecules, each comprising a Shiga toxin A Subunit effector polypeptide having one ectopic, pyrroline-carboxy-lysine residue, are created and tested. These cell-targeting molecules each comprised a cell-targeting, immunoglobulin-type, binding region comprising a polypeptide capable of binding to an extracellular target biomolecule with high-affinity.

The parental, Shiga toxin effector polypeptide of this Example is the A1 fragment of the A Subunit of Shiga toxin (SEQ ID NO:2), Shiga-like toxin 1 (SEQ ID NO:1), and Shiga-like toxin 2 (SLT-2A) (SEQ ID NO:3), optionally comprising the substitution C241S or C242S to remove the only endogenous, cysteine residue of the parental molecule. Using standard techniques, the parental, Shiga toxin effector polypeptide is used to make various Shiga toxin effector polypeptides, each having one unique and ectopic pyrroline-carboxy-lysine residue and optionally no lysine residues (see e.g. Table 17). Cell-targeting molecules comprising Shiga toxin effector polypeptides having exactly one of the ectopic pyrroline-carboxy-lysine residues described in Table 17 are made using standard techniques and tested as described in the Examples above. In Table 17, the code "Pcl" refers to pyrroline-carboxy-lysine.

TABLE 17

Ectopic, Pyrroline-Carboxy-Lysine Residues Engineered into Shiga Toxin Effector Polypeptides

| Shiga Toxin Effector Polypeptide StxA-Pcl(p), SLT-1A-Pcl(p), or SLT-2A-Pcl(p) | Unique Pcl Residue Substitution Position |
|---|---|
| StxA-Pcl1 | K1Pcl |
| StxA-Pcl2 | K11Pcl |

TABLE 17-continued

| Ectopic, Pyrroline-Carboxy-Lysine Residues Engineered into Shiga Toxin Effector Polypeptides | |
|---|---|
| Shiga Toxin Effector Polypeptide StxA-Pcl(p), SLT-1A-Pcl(p), or SLT-2A-Pcl(p) | Unique Pcl Residue Substitution Position |
| StxA-Pcl3 | K27Pcl |
| SLT-1A-Pcl1 | K1Pcl |
| SLT-1A-Pcl2 | K11Pcl |
| SLT-1A-Pcl3 | K274Pcl |
| SLT-2A-Pcl1 | K11Pcl |
| SLT-2A-Pcl2 | K255Pcl |
| SLT-2A-Pcl3 | K257Pcl |
| SLT-2A-Pcl4 | K270Pcl |
| SLT-2A-Pcl5 | K288Pcl |

Exemplary, cell-targeting molecules of the present invention are tested for retention of Shiga toxin A Subunit functions after introduction of pyrroline-carboxy-lysine residues into their Shiga toxin effector polypeptide components. The Shiga toxin A Subunit functions analyzed are: catalytic activity, inhibition of eukaryotic ribosome function, cytotoxicity, and by inference self-directing subcellular routing to the cytosol.

The catalytic activities of Shiga toxin effector polypeptide components of exemplary, cell-targeting molecules of this Example are tested using a ribosome inhibition assay. The ribosome inactivation activities of all the Shiga toxin effector polypeptides SLT-1A-Pcl(p) tested in the context of a cell-targeting molecule are equivalent to the catalytic activity of similarly de-immunized Shiga toxin effector polypeptides comprising all the natively occurring lysine residues and/or wild-type, Shiga toxin A1 fragments (amino acids 1-251 of SEQ ID NO:1 or SEQ ID NO:2; or amino acids 1-250 of SEQ ID NO:3).

The potency and specificity of cytotoxic activities of exemplary, cell-targeting molecules of this Example, which each comprised a Shiga toxin effector polypeptide SLT-1A-Pcl(p), are determined using a tissue culture cell-based cytotoxicity assay known to the skilled worker. The exemplary cell-targeting molecules of the present invention are each cytotoxic to target positive cells, commonly exhibiting $CD_{50}$ values less than 100 nM, depending on the cell-line tested. The cytotoxicities of many of the Shiga toxin effector polypeptides tested as a component of a cell-targeting molecule are comparable to the cytotoxicities of a related, Shiga toxin effector polypeptide comprising all the natively occurring lysine residues and no pyrroline-carboxy-lysine residues or alternatively a wild-type, Shiga toxin A1 fragment.

Exemplary cell-targeting molecules of this Example are produced, purified and conjugated to another molecule via a pyrroline-carboxy-lysine residue of the cell-targeting molecule using routine methods known to the skilled worker, such as, e.g., wherein the other molecule comprises a succinimidyl ester-fluorescent dye or iso/isothio-cyanate-fluorescent dye. These cell-targeting molecules are tested for cell-targeting, internalization, multimerization, and/or cytotoxicity as described in Example 5. The results of cytotoxicity assays show that cargo-linked cell-targeting molecules of this Example retain potent and specific cytotoxicity to target positive cells that is comparable in potency and activity to unconjugated variants of these cell-targeting molecules. The results of the experiments in this Example demonstrate that a cargo molecule can be conjugated to a pyrroline-carboxy-lysine residue of a Shiga toxin effector polypeptide component of a cell-targeting molecule of the present invention, and, furthermore, such conjugated cell-targeting molecules exhibit a useful level of cargo molecule delivery to the interior of a target positive cell and/or cytotoxicity to targeted cells.

Example 12. Cell-Targeting Molecules Targeting Various Cell Types, Each Comprising a Shiga Toxin A Subunit Effector Polypeptide of the Present Invention In this example, cell-targeting molecules of the present invention are created using one or more Shiga toxin effector polypeptides described herein to provide a unique amino acid residue for site-specific attachment of a cargo and/or cell-targeting molecule altering agent wherein the Shiga toxin effector polypeptide(s) also provide two or more of the following: 1) de-immunization, 2) protease-cleavage resistance, and/or 3) an embedded or inserted, heterologous, T-cell epitope. An immunoglobulin-type binding region is derived from the molecules chosen from column 1 of Table 18 and which binds the extracellular target biomolecule indicated in column 2 of Table 18. The selected immunoglobulin-type binding region and Shiga toxin effector polypeptide are associated with each other. The exemplary proteins of this example are optionally created with a carboxy-terminal KDEL-type signal motif ("KDEL" disclosed as SEQ ID NO:1142) using techniques known in the art and optionally linked to an additional exogenous material, such as, e.g., a useful agent: detection-promoting agent, solubility-altering agent, pharmacokinetic-altering agent, immunogenicity-altering agent, and/or pharmacodynamic-altering agent like a polyethylene glycol or serum albumin, and/or an additional exogenous material: a peptide, protein, nucleic acid, protein-nucleic acid complex, cytotoxic agent, or antibiotic like an antigen, enzyme, or messenger RNA. The resulting molecules are tested for any function required to be categorized as a cell-targeting molecule of the present invention as described in the previous examples using cells expressing the appropriate extracellular target biomolecules.

TABLE 18

| Various Binding Regions for Cell-Targeting Molecules of the Present Invention | | |
|---|---|---|
| Source of binding region | Extracellular target | Application(s) |
| alemtuzumab | CD52 | B-cell cancers, such as lymphoma and leukemia, and B-cell related immune disorders, such as autoimmune disorders |
| basiliximab | CD25 | T-cell disorders, such as prevention of organ transplant rejections, and some B-cell lineage cancers |
| brentuximab | CD30 | hematological cancers, B-cell related immune disorders, and T-cell related immune disorders |

TABLE 18-continued

| Various Binding Regions for Cell-Targeting Molecules of the Present Invention | | |
|---|---|---|
| Source of binding region | Extracellular target | Application(s) |
| catumaxomab | EpCAM | various cancers, such as ovarian cancer, malignant ascites, gastric cancer |
| cetuximab | EGFR | various cancers, such as colorectal cancer and head and neck cancer |
| daclizumab | CD25 | B-cell lineage cancers and T-cell disorders, such as rejection of organ transplants |
| daratumumab | CD38 | hematological cancers, B-cell related immune disorders, and T-cell related immune disorders |
| dinutuximab | ganglioside GD2 | Various cancers, such as breast cancer, myeloid cancers, and neuroblastoma |
| efalizumab | LFA-1 (CD11a) | autoimmune disorders, such as psoriasis |
| enoblituzumab | CD276 (B7-H3) | various cancers and immune disorders |
| ertumaxomab | HER2/neu | various cancers and tumors, such as breast cancer and colorectal cancer |
| gemtuzumab | CD33 | myeloid cancer or immune disorder |
| ibritumomab | CD20 | B-cell cancers, such as lymphoma and leukemia, and B-cell related immune disorders, such as autoimmune disorders |
| ipilimumab | CD152 | T-cell related disorders and various cancers, such as leukemia, melanoma |
| muromonab | CD3 | prevention of organ transplant rejections |
| natalizumab | integrin α4 | autoimmune disorders, such as multiple sclerosis and Crohn's disease |
| obinutuzumab | CD20 | B-cell cancers, such as lymphoma and leukemia, and B-cell related immune disorders, such as autoimmune disorders |
| ocaratuzumab | CD20 | B-cell cancers, such as lymphoma and leukemia, and B-cell related immune disorders, such as autoimmune disorders |
| ocrelizumab | CD20 | B-cell cancers, such as lymphoma and leukemia, and B-cell related immune disorders, such as autoimmune disorders |
| ofatumumab | CD20 | B-cell cancers, such as lymphoma and leukemia, and B-cell related immune disorders, such as autoimmune disorders |
| palivizumab | F protein of respiratory syncytial virus | treat respiratory syncytial virus |
| panitumumab | EGFR | various cancers, such as colorectal cancer and head and neck cancer |
| pertuzumab | HER2/neu | various cancers and tumors, such as breast cancer and colorectal cancer |
| pro 140 | CCR5 | HIV infection and T-cell disorders |
| ramucirumab | VEGFR2 | various cancers and cancer related disorders, such as solid tumors |
| rituximab | CD20 | B-cell cancers, such as lymphoma and leukemia, and B-cell related immune disorders, such as autoimmune disorders |
| tocilizumab or atlizumab | IL-6 receptor | autoimmune disorders, such as rheumatoid arthritis |
| tositumomab | CD20 | B-cell cancers, such as lymphoma and leukemia, and B-cell related immune disorders, such as autoimmune disorders |
| trastuzumab colorectal cancer | HER2/neu | various cancers and tumors, such as breast cancer and |
| ublituximab | CD20 | B-cell cancers, such as lymphoma and leukemia, and B-cell related immune disorders, such as autoimmune disorders |
| vedolizumab | integrin α4β7 | autoimmune disorders, such as Crohn's disease and ulcerative colitis |
| CD20 binding antibodies, scFv(s), and fibronectin domain(s) $FN3_{CD20}$ | CD20 | B-cell cancers, such as lymphoma and leukemia, and B-cell related immune disorders, such as autoimmune disorders (see e.g. Geng S et al., Cell Mol Immunol 3: 439-43 (2006); Olafesn T et al., Protein Eng Des Sel 23: 243-9 (2010); Natarajan A et al., Clin Cancer Res 19: 6820-9 (2013)) |
| CD22 binding scFv(s) | CD22 | B-cell cancers or B-cell related immune disorders (see e.g. Kawas S et al., MAbs 3: 479-86 (2011)) |
| CD24 binding monoclonal antibody(ies) | CD24 | various cancers, such as bladder cancer (see e.g. Kristiansen G et al., Lab Invest 90: 1102-16 (2010)) |
| CD25 binding scFv(s) | CD25 | various cancers of the B-cell lineage and immune disorders related to T-cells (see e.g. Muramatsu H et al., Cancer Lett 225: 225-36 (2005)) |

TABLE 18-continued

Various Binding Regions for Cell-Targeting Molecules of the Present Invention

| Source of binding region | Extracellular target | Application(s) |
|---|---|---|
| CD30 binding monoclonal antibody(ies) | CD30 | B-cell cancers or B-cell/T-cell related immune disorders (see e.g. Klimka A et al., Br J Cancer 83: 252-60 (2000)) |
| CD33 binding monoclonal antibody(ies) | CD33 | myeloid cancer or immune disorder (see e.g. Benedict C et al., J Immunol Methods 201: 223-31 (1997)) |
| CD38 binding immunoglobulin domains | CD38 | hematological cancers, B-cell related immune disorders, and T-cell related immune disorders (see e.g. U.S. Pat. No. 8,153,765) |
| CD40 binding scFv(s) | CD40 | various cancers and immune disorders (see e.g. Ellmark P et al., Immunology 106: 456-63 (2002)) |
| CD45 binding monoclonal antibody(ies) and scFv(s) | CD45 | Hematological cancers and myelodysplastic syndromes (see e.g. Matthews D et al., Blood 94: 1237-47 (1999); Lin Y et al., Cancer Res 66: 3884-92 (2006); Pagel J et al., Blood 107: 2184-91 (2006)) |
| CD52 binding monoclonal antibody(ies) | CD52 | B-cell cancers, such as lymphoma and leukemia, and B-cell related immune disorders, such as autoimmune disorders (see e.g. U.S. Pat. No. 7,910,104) |
| CD56 binding monoclonal antibody(ies) | CD56 | immune disorders and various cancers, such as lung cancer, Merkel cell carcinoma, myeloma (see e.g. Shin J et al., Hybridoma 18: 521-7 (1999)) |
| CD79 binding monoclonal antibody(ies) | CD79 | B-cell cancers or B-cell related immune disorders (see e.g. Zhang Let al., Ther Immunol 2: 191-202 (1995)) |
| CD133 binding monoclonal antibodies and scFv(s) | CD133 | various cancers, hematologic malignancies, and immune disorders (see e.g. Bidlingmaier S et al., JMol Med 86: 1025-32(2008); Pavlon Let al., J Microsc 231: 374-83 (2008); Rappa Get al., Stem Cells 26: 3008-17 (2008); Swaminathan S et al., J Immunol Methods 361: 110-5 (2010); Wang J et al., Hybridoma 29: 241-9 (2010); Zhu X et al., Mol Cancer Ther 9: 2131-41(2010); Xia J et al., Sci Rep 3: 3320 (2013)) |
| CD248 binding scFv(s) | CD248 | various cancers, such as inhibiting angiogenesis (see e.g. Zhao A etal., J Immunol Methods 363: 221-32 (2011)) |
| CEA-binding antibody(ies), scFv(s), and engineered, fibronectin domain(s) $FN3_{CEA}$ | CEA | various cancers, such as gastrointestinal cancer, pancreatic cancer, lung cancer, and breast cancer (see e.g. Neumaier M et al., Cancer Res 50: 2128-34 (1990); Pavoni E etal., BMC Cancer 6: 4 (2006); Yazaki P etal., Nucl Med Bol 35: 151-8 (2008); Zhao J etal., Oncol Res 17: 217-22 (2008); Pirie C etal., J Biol Chem 286: 4165-72 (2011)) |
| EGFR-binding Adnectin(s) and Affibody(ies) | EGFR | various cancers (see e.g. GenBank Accession: 3QWQ_B; GenBank Accession: 2KZI_A; U.S. Pat. No. 8,598,113) |
| EpCAM binding monoclonal antibody(ies) | EpCAM | various cancers, such as ovarian cancer, malignant ascites, gastric cancer (see e.g. Schanzer J et al., J Immunother 29: 477-88 (2006)) |
| PSMA binding monoclonal antibody(ies) | PSMA | prostate cancer (see e.g. Frigerio B etal., Eur J Cancer 49: 2223-32 (2013)) |
| Eph-B2 binding monoclonal antibody(ies) | Eph-B2 | various cancers such as colorectal cancer and prostate cancer (see e.g. Abengozar M et al., Blood 119: 4565-76 (2012)) |
| Endoglin binding monoclonal antibody(ies) | Endoglin | various cancers, such as breast cancer and colorectal cancers (see e.g. Wilke' T et al., Biochim Biophys Res Acta 1663: 158-66 (2004)) |
| FAP binding monoclonal antibody(ies) | FAP | various cancers, such as sarcomas and bone cancers (see e.g. Zhang J et al., FASEB J27: 581-9 (2013)) |
| HER2-binding monoclonal antibodies, scFvs, $V_HH_S$, and DARPins | HER2/neu | various cancers, such as breast cancer and colorectal cancer (see e.g. Zahnd C et al., JMol Blot 369: 1015-28 (2007); WO 1993/21319; WO 1994/00136; WO 1997/00271; WO 1998/77797; U.S. Pat. No. 5,772,997; U.S. Pat. No. 5,783,186; U.S. Pat. No. 5,821,337; U.S. Pat. No. 5,840,525; U.S. Pat. No. 6,949,245; U.S.Pat. No. 7,625,859; US2011/0059090; Goldstein Ret al., Eur J Nucl Med Mol Imaging 42: 288-301 (2015)) |
| LewisY antigen binding monoclonal antibody(ies) and scFv(s) | LewisY antigens | various cancers, such as cervical and uterine cancer (see e.g. Power B et al., Protein Sci 12: 734-47 (2003); Feridani A etal., Cytometry 71: 361-70 (2007)) |

TABLE 18-continued

Various Binding Regions for Cell-Targeting Molecules of the Present Invention

| Source of binding region | Extracellular target | Application(s) |
|---|---|---|
| Neurotensin receptor binding antibodies and DARPin(s) | neurotensin receptors | various cancers (see e.g. GenBank Accession: 2P2C_R); Ovigne J etal., Neuropeptides 32: 247-56 (1998); Haase C et al., Anticancer Res 3527-33 (2006)) |
| adalimumab | TNF-α | various cancers and immune disorders, such as rheumatoid arthritis, Crohn's Disease, plaque psoriasis, psoriatic arthritis, ankylosing spondylitis, juvenile idiopathic arthritis, hemolytic disease of the newborn |
| afelimomab | TNF-α | various cancers and immune disorders |
| ald518 | IL-6 | various cancers and immune disorders, such as rheumatoid arthritis |
| anrukinzumab or ima-638 | IL-13 | various cancers and immune disorders |
| briakinumab | IL-12, IL-23 | various cancers and immune disorders, such as psoriasis, rheumatoid arthritis, inflammatory bowel diseases, multiple sclerosis |
| brodalumab | IL-17 | various cancers and immune disorders, such as inflammatory diseases |
| canakinumab | IL-1 | various cancers and immune disorders, such as rheumatoid arthritis |
| certolizumab | TNF-α | various cancers and immune disorders, such as Crohn's disease |
| fezakinumab | IL-22 | various cancers and immune disorders, such as rheumatoid arthritis, psoriasis |
| ganitumab | IGF-I | various cancers |
| golimumab | TNF-α | various cancers and immune disorders, such as rheumatoid arthritis, psoriatic arthritis, ankylosing spondylitis |
| infliximab | TNF-α | various cancers and immune disorders, such as rheumatoid arthritis, ankylosing spondylitis, psoriatic arthritis, psoriasis, Crohn's disease, ulcerative colitis |
| ixekizumab | IL-17A | various cancers and immune disorders, such as autoimmune diseases |
| mepolizumab | IL-5 | various immune disorders and cancers, such as B-cell cancers |
| nerelimomab | TNF-α | various cancers and immune disorders |
| olokizumab | IL6 | various cancers and immune disorders |
| ozoralizumab | TNF-a | inflammation |
| perakizumab | IL-17A | various cancers and immune disorders, such as arthritis |
| placulumab | human TNF | various immune disorders and cancers |
| sarilumab | IL6 | various cancers and immune disorders, such as rheumatoid arthritis, ankylosing spondylitis |
| siltuximab | IL-6 | various cancers and immune disorders |
| sirukumab | IL-6 | various cancers and immune disorders, such as rheumatoid arthritis |
| tabalumab | BAFF | B-cell cancers |
| ticilimumab or tremelimumab | CTLA-4 | various cancers |
| tildrakizumab | IL23 | immunologically mediated inflammatory disorders |
| tnx-650 | IL-13 | various cancers and immune disorders, such as B-cell cancers |
| tocilizumab or atlizumab | IL-6 receptor | various cancers and immune disorders, such as rheumatoid arthritis |
| ustekinumab | IL-12, IL-23 | various cancers and immune disorders, such as multiple sclerosis, psoriasis, psoriatic arthritis |
| Various growth factors: VEGF, EGF1, EGF2, FGF | VEGFR, EGFR, FGFR | various cancer, such as breast cancer and colon cancer, and to inhibit vascularization |
| Various cytokines: IL-2, IL-6, IL-23, CCL2, BAFFs, TNFs, RANKL | IL-2R, IL-6R, IL-23R, CD80/CD86, TNFRSF13/TNFRSF17, TNFR | various immune disorders and cancers |
| Various antibodies | Epstein-Barr virus latent membrane protein (LMP1) | various cancers, viral infections, and immune disorders (see e.g. Chan B et al., In J Cancer 102: 492-8 (2002); Fang C et al., J Immunol Methods 287: 21-30 (2004)); Nichols J et al., J Virol Methods 116: 79-88 (2004); Sim A et al., Sci Rep 3: 3232 (2013)) |

TABLE 18-continued

| Various Binding Regions for Cell-Targeting Molecules of the Present Invention | | |
|---|---|---|
| Source of binding region | Extracellular target | Application(s) |
| Broadly neutralizing antibodies identified from patient samples | Influenza surface antigens (e.g. hemaglutinins and matrix protein 2) | viral infections (see e.g. Prabakaran P et al., Front Microbiol 3: 277 (2012)) |
| Broadly neutralizing antibodies identified from patient samples | Coronavirus surface antigens | viral infections (see e.g. Prabakaran P et al., Front Microbiol 3: 277 (2012)) |
| Various antibodies | Filovirus surface antigens (e.g. VP35, VP40, and glycoprotein) | viral infections (see e.g. Olinger Get al., Proc Natl Acad Sci USA 109: 18030-5 (2012); Pettitt J et al., Sci Transl Med 5: 199ra113 (2013); Stahelin R, Expert Opin Ther Targets 18:115-20 (2014); Becquart P et al., PLoS One 9: e96360 (2014); Stahelin R, Fron Microbiol 5: 300 (2014); Tran E et al., J Virol 88: 10958-62 (2014); Murin C et al., Proc Natl Acad Sci USA 111: 17182-7 (2014)) |
| Broadly neutralizing antibodies identified from patient samples | Henipavirus surface antigens | viral infections (see e.g. Prabakaran P et al., Front Microbiol 3: 277 (2012)) |
| Various antibodies including broadly neutralizing antibodies and scFvs | HIV surface antigens (e.g. matrix protein Map17) | viral infections (see e.g. Kitidee K et al., BMC Biotechnol 10: 80 (2010); Yu L, Guan Y, Front Immunol 5: 250 (2014)) |

While some embodiments of the invention have been described by way of illustration, it will be apparent that the invention may be put into practice with many modifications, variations and adaptations, and with the use of numerous equivalents or alternative solutions that are within the scope of persons skilled in the art, without departing from the spirit of the invention or exceeding the scope of the claims.

All publications, patents, and patent applications are herein incorporated by reference in their entirety to the same extent as if each individual publication, patent or patent application was specifically and individually indicated to be incorporated by reference in its entirety. The patent application publications WO 2005/092917, WO 2007/033497, US 2013/196928, WO 2014/164680, WO 2014/164693, WO 2015/113005, WO 2015/113007, WO 2015/120058, WO 2015/138435, WO 2015/138452, US 2015/0259428, WO 2015/191764, US2016/177284, WO 2016/126950, WO 2016/196344, and WO 2017/019623 are each incorporated herein by reference in its entirety. The disclosure of U.S. patent application 62/431,036 is incorporated herein by reference in its entirety. The complete disclosures of all electronically available biological sequence information from GenBank (National Center for Biotechnology Information, U.S.) for amino acid and nucleotide sequences cited herein are each incorporated herein by reference in their entirety.

| Sequence Listing | | |
|---|---|---|
| ID Number | Text Description | Biological Sequence |
| SEQ ID NO: 1 | Shiga-like toxin 1 Subunit A (SLT-1A) | KEFTLDFSTAKTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASRVARM<br>ASDEFPSMCPADGRVRGITHNKILWDSSTLGAILMRRTISS |
| SEQ ID NO: 2 | Shiga toxin Subunit A (StxA) | KEFTLDFSTAKTYVDSLNVIRSAIGTPLQTISSGGTSLLMIDSG<br>TGDNLFAVDVRGIDPEEGRFNNLRLIVERNNLYVTGFVNRT<br>NNVFYRFADFSHVTFPGTTAVTLSGDSSYTTLQRVAGISRTG<br>MQINRHSLTTSYLDLMSHSGTSLTQSVARAMLRFVTVTAEA<br>LRFRQIQRGFRTTLDDLSGRSYVMTAEDVDLTLNWGRLSSV<br>LPDYHGQDSVRVGRISFGSINAILGSVALILNCHHHASRVAR<br>MASDEFPSMCPADGRVRGITHNKILWDSSTLGAILMRRTISS |
| SEQ ID NO: 3 | Shiga-like toxin 2 Subunit A (SLT-2A) | DEFTVDFSSQKSYVDSLNSIRSAISTPLGNISQGGVSVSVINH<br>VLGGNYISLNVRGLDPYSERFNHLRLIMERNNLYVAGFINTE<br>TNIFYRFSDFSHISVPDVITVSMTTDSSYSSLQRIADLERTGM<br>QIGRHSLVGSYLDLMEFRGRSMTRASSRAMLRFVTVIAEAL<br>RFRQIQRGFRPALSEASPLYTMTAQDVDLTLNWGRISNVLPE |

-continued

Sequence Listing

| ID Number | Text Description | Biological Sequence |
|---|---|---|
| | | YRGEEGVRIGRISFNSLSAILGSVAVILNCHSTGSYSVRSVSQ KQKTECQIVGDRAAIKVNNVLWEANTIAALLNRKPQDLTEP NQ |
| SEQ ID NO: 4 | parental, Shiga toxin effector polypeptide | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 5 | SLT-1A-Cys1 | CEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 6 | SLT-1A-Cys2 | KEFTLDFCTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 7 | SLT-1A-Cys3 | KEFTLDFSTAKTYVDCLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 8 | SLT-1A-Cys4 | KEFTLDFSTAKTYVDSLNVIRCAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 9 | SLT-1A-Cys5 | KEFTLDFSTAKTYVDSLNVIRSAIGTPLQTISCGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 10 | SLT-1A-Cys6 | KEFTLDFSTAKTYVDSLNVIRSAIGTPLQTISSGGTSLLMIDCG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 11 | SLT-1A-Cys7 | KEFTLDFSTAKTYVDSLNVIRSAIGTPLQTISSGGTSLLMIDSG CGDNLFAVDVRGIDPEEGRFNNLRLIVERNNLYVTGFVNRT NNVFYRFADFSHVTFPGTTAVTLSGDSSYTTLQRVAGISRTG MQINRHSLTTSYLDLMSHSGTSLTQSVARAMLRFVTVTAEA LRFRQIQRGFRTTLDDLSGRSYVMTAEDVDLTLNWGRLSSV LPDYHGQDSVRVGRISFGSINAILGSVALILNSHHHASRVAR |
| SEQ ID NO: 12 | SLT-1A-Cys8 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHCGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 13 | SLT-1A-Cys9 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLCGRSYVMTAEDVDLTLNWGRLSSVL PDYHGQDSVRVGRISFGSINAILGSVALILNSHHHASRVAR |

-continued

Sequence Listing

| ID Number | Text Description | Biological Sequence |
|---|---|---|
| SEQ ID NO: 14 | SLT-1A-Cys10 | KEFTLDFSTAKTYVDSLNVIRSAIGTPLQTISSGGTSLLMIDSG SGDNLFAVDCRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 15 | SLT-1A-Cys1-FR | CEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 16 | SLT-1A-Cys2-FR | KEFTLDFCTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 17 | SLT-1A-Cys3-FR | KEFTLDFSTAKTYVDCLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 18 | SLT-1A-Cys4-FR | KEFTLDFSTAKTYVDSLNVIRCAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 19 | SLT-1A-Cys5-FR | KEFTLDFSTAKTYVDSLNVIRSAIGTPLQTISCGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHRHASAVAA |
| SEQ ID NO: 20 | SLT-1A-Cys6-FR | KEFTLDFSTAKTYVDSLNVIRSAIGTPLQTISSGGTSLLMIDCG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 21 | SLT-1A-Cys7-FR | KEFTLDFSTAKTYVDSLNVIRSAIGTPLQTISSGGTSLLMIDSG CGDNLFAVDVRGIDPEEGRFNNLRLIVERNNLYVTGFVNRT NNVFYRFADFSHVTFPGTTAVTLSGDSSYTTLQRVAGISRTG MQINRHSLTTSYLDLMSHSGTSLTQSVARAMLRFVTVTAEA LRFRQIQRGFRTTLDDLSGRSYVMTAEDVDLTLNWGRLSSV LPDYHGQDSVRVGRISFGSINAILGSVALILNSHRHASAVAA |
| SEQ ID NO: 22 | SLT-1A-Cys8-FR | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHCGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 23 | SLT-1A-Cys9-FR | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLCGRSYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 24 | SLT-1A-Cys10-FR | KEFTLDFSTAKTYVDSLNVIRSAIGTPLQTISSGGTSLLMIDSG SGDNLFAVDCRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 25 | SLT-1A-Cys1-D1 | CEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 26 | SLT-1A-Cys2-D1 | KEFTLDFCTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO : 27 | SLT-1A-Cys3-D1 | KEFTLDFSTAKTYVDCLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 28 | SLT-1A-Cys4-D1 | KEFTLDFSTAKTYVDSLNVIRCAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 29 | SLT-1A-Cys5-D1 | KEFTLDFSTAKTYVDSLNVIRSAIGTPLQTISCGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 30 | SLT-1A-Cys6-D1 | KEFTLDFSTAKTYVDSLNVIRSAIGTPLQTISSGGTSLLMIDCG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 31 | SLT-1A-Cys7-D1 | KEFTLDFSTAKTYVDSLNVIRSAIGTPLQTISSGGTSLLMIDSG CGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 32 | SLT-1A-Cys8-D1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHCGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 33 | SLT-1A-Cys9-D1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLCGASYVMTAEDVDLTLNWGRLSSVL PDYHGQDSVRVGRISFGSINAILGSVALILNSHHHASRVAR |

-continued

Sequence Listing

| ID Number | Text Description | Biological Sequence |
|---|---|---|
| SEQ ID NO: 34 | SLT-1A-Cys10-D1 | KEFTLDFSTAKTYVDSLNVIRSAIGTPLQTISSGGTSLLMIDSG IGDNLFAVDCRGIDPEEGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 35 | SLT-1A-Cys1-D2 | CEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 36 | SLT-1A-Cys2-D2 | KEFTLDFCTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 37 | SLT-1A-Cys3-D2 | KEFTLDFSTAKTYVDCLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 38 | SLT-1A-Cys4-D2 | KEFTLDFSTAKTYVDSLNVIRCAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 39 | SLT-1A-Cys5-D2 | KEFTLDFSTAKTYVDSLNVIRSAIGTPLQTISCGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 40 | SLT-1A-Cys6-D2 | KEFTLDFSTAKTYVDSLNVIRSAIGTPLQTISSGGTSLLMIDCG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 41 | SLT-1A-Cys7-D2 | KEFTLDFSTAKTYVDSLNVIRSAIGTPLQTISSGGTSLLMIDSG CGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 42 | SLT-1A-Cys8-D2 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHCATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 43 | SLT-1A-Cys9-D2 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLCGASYVMTAEDVDLTLNWGRLSSVL PDYHGQDSVRVGRISFGSINAILGSVALILNSHHHASRVAR |
| SEQ ID NO: 44 | SLT-1A-Cys10-D2 | KEFTLDFSTAKTYVDSLNVIRSAIGTPLQTISSGGTSLLMIDSG IGDNLFAVDCRGIDPEEGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASRVAR |
| SEQ ID NO: 45 | SLT-1A-Cys1 (inactivated) | CEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 46 | SLT-1A-Cys2 (inactivated) | KEFTLDFCTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 47 | SLT-1A-Cys3 (inactivated) | KEFTLDFSTAKTYVDCLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 48 | SLT-1A-Cys4 (inactivated) | KEFTLDFSTAKTYVDSLNVIRCAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 49 | SLT-1A-Cys5 (inactivated) | KEFTLDFSTAKTYVDSLNVIRSAIGTPLQTISCGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 50 | SLT-1A-Cys6 (inactivated) | KEFTLDFSTAKTYVDSLNVIRSAIGTPLQTISSGGTSLLMIDCG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 51 | SLT-1A-Cys7 (inactivated) | KEFTLDFSTAKTYVDSLNVIRSAIGTPLQTISSGGTSLLMIDSG CGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 52 | SLT-1A-Cys8 (inactivated) | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHCGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 53 | SLT-1A-Cys9 (inactivated) | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLCGRSYVMTAEDVDLTLNWGRLSSVL PDYHGQDSVRVGRISFGSINAILGSVALILNSHHHASRVAR |
| SEQ ID NO: 54 | SLT-1A-Cys10 (inactivated) | KEFTLDFSTAKTYVDSLNVIRSAIGTPLQTISSGGTSLLMIDSG SGDNLFAVDCRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 55 | SLT-1A-Cys1-FR (inactivated) | CEFTLDFSTAKTYVDSLNVIRSAIGTPLQTISSGGTSLLMIDSG SGDNLFAVDVRGIDPEEGRFNNLRLIVERNNLSVTGFVNRTN |

-continued

Sequence Listing

| ID Number | Text Description | Biological Sequence |
|---|---|---|
| | | NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 56 | SLT-1A-Cys2-FR (inactivated) | KEFTLDFCTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 57 | SLT-1A-Cys3-FR (inactivated) | KEFTLDFSTAKTYVDCLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 58 | SLT-1A-Cys4-FR (inactivated) | KEFTLDFSTAKTYVDSLNVIRCAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 59 | SLT-1A-Cys5-FR (inactivated) | KEFTLDFSTAKTYVDSLNVIRSAIGTPLQTISCGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 60 | SLT-1A-Cys6-FR (inactivated) | KEFTLDFSTAKTYVDSLNVIRSAIGTPLQTISSGGTSLLMIDCG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 61 | SLT-1A-Cys7-FR (inactivated) | KEFTLDFSTAKTYVDSLNVIRSAIGTPLQTISSGGTSLLMIDSG<br>CGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 62 | SLT-1A-Cys8-FR (inactivated) | KEFTLDFSTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHCGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 63 | SLT-1A-Cys9-FR (inactivated) | KEFTLDFSTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLCGRSYVMTAEDVDLTLNWGRLSSVL<br>PDYHGQDSVRVGRISFGSINAILGSVALILNSHHHASAVAA |
| SEQ ID NO: 64 | SLT-1A-Cys10-FR (inactivated) | KEFTLDFSTAKTYVDSLNVIRSAIGTPLQTISSGGTSLLMIDSG<br>SGDNLFAVDCRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 65 | SLT-1A-Cys1-D1 (inactivated) | CEFTLDFSTAKTYVDSLNVIRSAIGTPLQTISSGGTSLLMIDSG<br>IGDNLFAVDILGFDFTLGRFNNLRLIVERNNLSVTGFVNRTN<br>NVFYRFADFSHVTFPGTTAVTLSADSSYTTLQRVAGISRTGM<br>QINRHSLTTSYLDLMSHSGTSLTQSVARAMLRFVTVTADAL<br>RFRQIQRGFRTTLDDLSGASYVMTAEDVDLTLNWGRLSSVL<br>PDYHGQDSVRVGRISFGSINAILGSVALILNSHHHASRVAR |

-continued

| Sequence Listing | | |
|---|---|---|
| ID Number | Text Description | Biological Sequence |
| SEQ ID NO: 66 | SLT-1A-Cys2-D1 (inactivated) | KEFTLDFCTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 67 | SLT-1A-Cys3-D1 (inactivated) | KEFTLDFSTAKTYVDCLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 68 | SLT-1A-Cys4-D1 (inactivated) | KEFTLDFSTAKTYVDSLNVIRCAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 69 | SLT-1A-Cys5-D1 (inactivated) | KEFTLDFSTAKTYVDSLNVIRSAIGTPLQTISCGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 70 | SLT-1A-Cys6-D1 (inactivated) | KEFTLDFSTAKTYVDSLNVIRSAIGTPLQTISSGGTSLLMIDCG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 71 | SLT-1A-Cys7-D1 (inactivated) | KEFTLDFSTAKTYVDSLNVIRSAIGTPLQTISSGGTSLLMIDSG CGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 72 | SLT-1A-Cys8-D1 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHCGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 73 | SLT-1A-Cys9-D1 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 74 | SLT-1A-Cys10-D1 (inactivated) | KEFTLDFSTAKTYVDSLNVIRSAIGTPLQTISSGGTSLLMIDSG IGDNLFAVDCRGIDPEEGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 75 | SLT-1A-Cys1-D2 (inactivated) | CEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |

-continued

Sequence Listing

| ID Number | Text Description | Biological Sequence |
|---|---|---|
| SEQ ID NO: 76 | SLT-1A-Cys-D2 (inactivated) | KEFTLDFCTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 77 | SLT-1A-Cys3-D2 (inactivated) | KEFTLDFSTAKTYVDCLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 78 | SLT-1A-Cys4-D2 (inactivated) | KEFTLDFSTAKTYVDSLNVIRCAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 79 | SLT-1A-Cys5-D2 (inactivated) | KEFTLDFSTAKTYVDSLNVIRSAIGTPLQTISCGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 80 | SLT-1A-Cys6-D2 (inactivated) | KEFTLDFSTAKTYVDSLNVIRSAIGTPLQTISSGGTSLLMIDCG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 81 | SLT-1A-Cys-D2 (inactivated) | KEFTLDFSTAKTYVDSLNVIRSAIGTPLQTISSGGTSLLMIDSG CGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 82 | SLT-1A-Cys8-D2 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHCATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 83 | SLT-1A-Cys9-D2 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLCGASYVMTAEDVDLTLNWGRLSSVL PDYHGQDSVRVGRISFGSINAILGSVALILNSHHHASRVAR |
| SEQ ID NO: 84 | SLT-1A-Cys10-D2 (inactivated) | KEFTLDFSTAKTYVDSLNVIRSAIGTPLQTISSGGTSLLMIDSG IGDNLFAVDCRGIDPEEGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 85 | SLT-1A-Cys1-D3 | CEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 86 | SLT-1A-Cys2-D3 | KEFTLDFCTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASAVAA |
| SEQ ID NO: 87 | SLT-1A-Cys3-D3 | KEFTLDFSTAKTYVDCLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 88 | SLT-1A-Cys4-D3 | KEFTLDFSTAKTYVDSLNVIRCAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 89 | SLT-1A-Cys5-D3 | KEFTLDFSTAKTYVDSLNVIRSAIGTPLQTISCGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |
| SEQ ID NO: 90 | SLT-1A-Cys6-D3 | KEFTLDFSTAKTYVDSLNVIRSAIGTPLQTISSGGTSLLMIDCG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |
| SEQ ID NO: 91 | SLT-1A-Cys7-D3 | KEFTLDFSTAKTYVDSLNVIRSAIGTPLQTISSGGTSLLMIDSG CGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |
| SEQ ID NO: 92 | SLT-1A-Cys8-D3 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHCGTSLTQSVARAMLRFVTVTAEAL RFRQIQRGFRTTLDDLSGASYVMTAEDVDLTLNWGRLSSVL SVRVGRISFGSINAILGSVALILNSHRHASAVAA |
| SEQ ID NO: 93 | SLT-1A-Cys9-D3 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLCGASYVMTAEDVDLTLNWGRLSSVL PDYHGQDSVRVGRISFGSINAILGSVALILNSHHHASAVAA |
| SEQ ID NO: 94 | SLT-1A-Cys10-D3 | KEFTLDFSTAKTYVDSLNVIRSAIGTPLQTISSGGTSLLMIDSG IGDNLFAVDCRGIDPEEGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |
| SEQ ID NO: 95 | SLT-1A-Cys1-D4 | CEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |
| SEQ ID NO: 96 | SLT-1A-Cys2-D4 | KEFTLDFCTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |

-continued

Sequence Listing

| ID Number | Text Description | Biological Sequence |
|---|---|---|
| SEQ ID NO: 97 | SLT-1A-Cys3-D4 | KEFTLDFSTAKTYVDCLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |
| SEQ ID NO: 98 | SLT-1A-Cys4-D4 | KEFTLDFSTAKTYVDSLNVIRCAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHRHASAVAA |
| SEQ ID NO: 99 | SLT-1A-Cys5-D4 | KEFTLDFSTAKTYVDSLNVIRSAIGTPLQTISCGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 100 | SLT-1A-Cys6-D4 | KEFTLDFSTAKTYVDSLNVIRSAIGTPLQTISSGGTSLLMIDCG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 101 | SLT-1A-Cys7-D4 | KEFTLDFSTAKTYVDSLNVIRSAIGTPLQTISSGGTSLLMIDSG CGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 102 | SLT-1A-Cys8-D4 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHCATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 103 | SLT-1A-Cys9-D4 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLCGASYVMTAEDVDLTLNWGRLSSVL PDYHGQDSVRVGRISFGSINAILGSVALILNSHHHASAVAA |
| SEQ ID NO: 104 | SLT-1A-Cys10-D4 | KEFTLDFSTAKTYVDSLNVIRSAIGTPLQTISSGGTSLLMIDSG IGDNLFAVDCRGIDPEEGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 105 | SLT-1A-Cys1-D3 (inactivated) | CEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 106 | SLT-1A-Cys2-D3 (inactivated) | KEFTLDFCTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 107 | SLT-1A-Cys3-D3 (inactivated) | KEFTLDFSTAKTYVDCLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL |

-continued

Sequence Listing

| ID Number | Text Description | Biological Sequence |
| --- | --- | --- |
| | | RFRQIQRGFRTTLDDLSGASYVMTAEDVDLTLNWGRLSSVL PDYHGQDSVRVGRISFGSINAILGSVALILNSHHHASAVAA |
| SEQ ID NO: 108 | SLT-1A-Cys4-D3 (inactivated) | KEFTLDFSTAKTYVDSLNVIRCAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 109 | SLT-1A-Cys5-D3 (inactivated) | KEFTLDFSTAKTYVDSLNVIRSAIGTPLQTISCGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 110 | SLT-1A-Cys6-D3 (inactivated) | KEFTLDFSTAKTYVDSLNVIRSAIGTPLQTISSGGTSLLMIDCG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 111 | SLT-1A-Cys7-D3 (inactivated) | KEFTLDFSTAKTYVDSLNVIRSAIGTPLQTISSGGTSLLMIDSG CGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 112 | SLT-1A-Cys8-D3 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHCGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 113 | SLT-1A-Cys9-D3 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLCGASYVMTAEDVDLTLNWGRLSSVL PDYHGQDSVRVGRISFGSINAILGSVALILNSHHHASAVAA |
| SEQ ID NO: 114 | SLT-1A-Cys10-D3 (inactivated) | KEFTLDFSTAKTYVDSLNVIRSAIGTPLQTISSGGTSLLMIDSG IGDNLFAVDCRGIDPEEGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 115 | SLT-1A-Cys1-D4 (inactivated) | CEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 116 | SLT-1A-Cys2-D4 (inactivated) | KEFTLDFCTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 117 | SLT-1A-Cys3-D4 (inactivated) | KEFTLDFSTAKTYVDCLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |

-continued

| Sequence Listing | | |
|---|---|---|
| ID Number | Text Description | Biological Sequence |
| SEQ ID NO: 118 | SLT-1A-Cys4-D4 (inactivated) | KEFTLDFSTAKTYVDSLNVIRCAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 119 | SLT-1A-Cys5-D4 (inactivated) | KEFTLDFSTAKTYVDSLNVIRSAIGTPLQTISCGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 120 | SLT-1A-Cys6-D4 (inactivated) | KEFTLDFSTAKTYVDSLNVIRSAIGTPLQTISSGGTSLLMIDCG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 121 | SLT-1A-Cys7-D4 (inactivated) | KEFTLDFSTAKTYVDSLNVIRSAIGTPLQTISSGGTSLLMIDSG CGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 122 | SLT-1A-Cys8-D4 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHCATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 123 | SLT-1A-Cys9-D4 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLCGASYVMTAEDVDLTLNWGRLSSVL PDYHGQDSVRVGRISFGSINAILGSVALILNSHHHASAVAA |
| SEQ ID NO: 124 | SLT-1A-Cys10-D4 (inactivated) | KEFTLDFSTAKTYVDSLNVIRSAIGTPLQTISSGGTSLLMIDSG IGDNLFAVDCRGIDPEEGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 125 | SLT-1A-Lys1 variant 1 | KEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 126 | SLT-1A-Lys1 variant 2 | KEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 127 | SLT-1A-Lys1 variant 3 | KEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 128 | SLT-1A-Lys1 variant 4 | KEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGRSYVMTAEDVDLTLNWGRLSSVL PDYHGQDSVRVGRISFGSINAILGSVALILNSHHHASRVAR |
| SEQ ID NO: 129 | SLT-1A-Lys2 variant 1 | REFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 130 | SLT-1A-Lys2 variant 2 | HEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 131 | SLT-1A-Lys2 variant 3 | DEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 132 | SLT-1A-Lys2 variant 4 | QEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 133 | SLT-1A-Lys2 variant 5 | SEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 134 | SLT-1A-Lys1-FR variant 1 | KEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 135 | SLT-1A-Lys1-FR variant 2 | KEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 136 | SLT-1A-Lys1-FR variant 3 | KEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 137 | SLT-1A-Lys1-FR variant 4 | KEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 138 | SLT-1A-Lys2-FR variant 1 | REFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 139 | SLT-1A-Lys2-FR variant 2 | HEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 140 | SLT-1A-Lys2-FR variant 3 | DEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 141 | SLT-1A-Lys2-FR variant 4 | QEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 142 | SLT-1A-Lys2-FR variant 5 | SEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 143 | SLT-1A-Lys1-D1 variant 1 | KEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 144 | SLT-1A-Lys1-D1 variant 2 | KEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 145 | SLT-1A-Lys1-D1 variant 3 | KEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 146 | SLT-1A-Lys1-D1 variant 4 | KEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 147 | SLT-1A-Lys2-D1 variant 1 | REFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 148 | SLT-1A-Lys2-D1 variant 2 | HEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 149 | SLT-1A-Lys2-D1 variant 3 | DEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASRVAR |
| SEQ ID NO: 150 | SLT-1A-Lys2-D1 variant 4 | QEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 151 | SLT-1A-Lys2-D1 variant 5 | SEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 152 | SLT-1A-Lys1-D2 variant 1 | KEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 153 | SLT-1A-Lys1-D2 variant 2 | KEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 154 | SLT-1A-Lys1-D2 variant 3 | KEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 155 | SLT-1A-Lys1-D2 variant 4 | KEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 156 | SLT-1A-Lys2-D2 variant 1 | REFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 157 | SLT-1A-Lys2-D2 variant 2 | HEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 158 | SLT-1A-Lys2-D2 variant 3 | DEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 159 | SLT-1A-Lys2-D2 variant 4 | QEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 160 | SLT-1A-Lys2-D2 variant 5 | SEFTLDFSTAKTYVDSLNVIRSAIGTPLQTISSGGTSLLMIDSG IGDNLFAVDILGFDFTLGRFNNLRLIVERNNLYVTGFVNRTN |

-continued

| Sequence Listing | | |
|---|---|---|
| ID Number | Text Description | Biological Sequence |
| | | NVFYRFADFSHVTFPGTTAVTLSADSSYTTLQRVAGISRTGM<br>QINRHSLTTSYLDLMSHSATSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 161 | SLT-1A-Lys1<br>variant 1<br>(inactivated) | KEFTLDFSTARTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 162 | SLT-1A-Lys1<br>variant 2<br>(inactivated) | KEFTLDFSTAHTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 163 | SLT-1A-Lys1<br>variant 3<br>(inactivated) | KEFTLDFSTAQTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 164 | SLT-1A-Lys1<br>variant 4<br>(inactivated) | KEFTLDFSTASTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 165 | SLT-1A-Lys2<br>variant 1<br>(inactivated) | REFTLDFSTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 166 | SLT-1A-Lys2<br>variant 2<br>(inactivated) | HEFTLDFSTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 167 | SLT-1A-Lys2<br>variant 3<br>(inactivated) | DEFTLDFSTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 168 | SLT-1A-Lys2<br>variant 4<br>(inactivated) | QEFTLDFSTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 169 | SLT-1A-Lys2<br>variant 5<br>(inactivated) | SEFTLDFSTAKTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 170 | SLT-1A-Lys1-FR<br>variant 1<br>(inactivated) | KEFTLDFSTARTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |

-continued

Sequence Listing

| ID Number | Text Description | Biological Sequence |
|---|---|---|
| SEQ ID NO: 171 | SLT-1A-Lys1-FR variant 2 (inactivated) | KEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 172 | SLT-1A-Lys1-FR variant 3 (inactivated) | KEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 173 | SLT-1A-Lys1-FR variant 4 (inactivated) | KEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 174 | SLT-1A-Lys2-FR variant 1 (inactivated) | REFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 175 | SLT-1A-Lys2-FR variant 2 (inactivated) | HEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 176 | SLT-1A-Lys2-FR variant 3 (inactivated) | DEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 177 | SLT-1A-Lys2-FR variant 4 (inactivated) | QEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 178 | SLT-1A-Lys2-FR variant 5 (inactivated) | SEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 179 | SLT-1A-Lys1-D1 variant 1 (inactivated) | KEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 180 | SLT-1A-Lys1-D1 variant 2 (inactivated) | KEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |

-continued

| Sequence Listing | | |
|---|---|---|
| ID Number | Text Description | Biological Sequence |
| SEQ ID NO: 181 | SLT-1A-Lys1-D1 variant 3 (inactivated) | KEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 182 | SLT-1A-Lys1-D1 variant 4 (inactivated) | KEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 183 | SLT-1A-Lys2-D1 variant 1 (inactivated) | REFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 184 | SLT-1A-Lys2-D1 variant 2 (inactivated) | HEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 185 | SLT-1A-Lys2-D1 variant 3 (inactivated) | DEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 186 | SLT-1A-Lys2-D1 variant 4 (inactivated) | QEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 187 | SLT-1A-Lys2-D1 variant 5 (inactivated) | SEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 188 | SLT-1A-Lys1-D2 variant 1 (inactivated) | KEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 189 | SLT-1A-Lys1-D2 variant 2 (inactivated) | KEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 190 | SLT-1A-Lys1-D2 variant 3 (inactivated) | KEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 191 | SLT-1A-Lys1-D2 variant 4 (inactivated) | KEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASRVAR |
| SEQ ID NO: 192 | SLT-1A-Lys2-D2 variant 1 (inactivated) | REFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 193 | SLT-1A-Lys2-D2 variant 2 (inactivated) | HEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 194 | SLT-1A-Lys2-D2 variant 3 (inactivated) | DEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 195 | SLT-1A-Lys2-D2 variant 4 (inactivated) | QEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 196 | SLT-1A-Lys2-D2 variant 5 (inactivated) | SEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 197 | SLT-1A-Lys1-D3 variant 1 | KEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 198 | SLT-1A-Lys1-D3 variant 2 | KEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 199 | SLT-1A-Lys1-D3 variant 3 | KEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 200 | SLT-1A-Lys1-D3 variant 4 | KEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 201 | SLT-1A-Lys2-D3 variant 1 | REFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 202 | SLT-1A-Lys2-D3 variant 2 | HEFTLDFSTAKTYVDSLNVIRSAIGTPLQTISSGGTSLLMIDSG IGDNLFAVDILGFDFTLGRFNNLRLIVERNNLYVTGFVNRTN |

-continued

Sequence Listing

| ID Number | Text Description | Biological Sequence |
|---|---|---|
| | | NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 203 | SLT-1A-Lys2-D3 variant 3 | DEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 204 | SLT-1A-Lys2-D3 variant 4 | QEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 205 | SLT-1A-Lys2-D3 variant 5 | SEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 206 | SLT-1A-Lys1-D4 variant 1 | KEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 207 | SLT-1A-Lys1-D4 variant 2 | KEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 208 | SLT-1A-Lys1-D4 variant 3 | KEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 209 | SLT-1A-Lys1-D4 variant 4 | KEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 210 | SLT-1A-Lys2-D4 variant 1 | REFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 211 | SLT-1A-Lys2-D4 variant 2 | HEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 212 | SLT-1A-Lys2-D4 variant 3 | DEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 213 | SLT-1A-Lys2-D4 variant 4 | QEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 214 | SLT-1A-Lys2-D4 variant 5 | SEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 215 | SLT-1A-Lys1-D3 variant 1 (inactivated) | KEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 216 | SLT-1A-Lys1-D3 variant 2 (inactivated) | KEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 217 | SLT-1A-Lys1-D3 variant 3 (inactivated) | KEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 218 | SLT-1A-Lys1-D3 variant 4 (inactivated) | KEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 219 | SLT-1A-Lys2-D3 variant 1 (inactivated) | REFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 220 | SLT-1A-Lys2-D3 variant 2 (inactivated) | HEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 221 | SLT-1A-Lys2-D3 variant 3 (inactivated) | DEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 222 | SLT-1A-Lys2-D3 variant 4 (inactivated) | QEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 223 | SLT-1A-Lys2-D3 variant 5 (inactivated) | SEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 224 | SLT-1A-Lys1-D4 variant 1 (inactivated) | KEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 225 | SLT-1A-Lys1-D4 variant 2 (inactivated) | KEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 226 | SLT-1A-Lys1-D4 variant 3 (inactivated) | KEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 227 | SLT-1A-Lys1-D4 variant 4 (inactivated) | KEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 228 | SLT-1A-Lys2-D4 variant 1 (inactivated) | REFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 229 | SLT-1A-Lys2-D4 variant 2 (inactivated) | HEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 230 | SLT-1A-Lys2-D4 variant 3 (inactivated) | DEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 231 | SLT-1A-Lys2-D4 variant 4 (inactivated) | QEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 232 | SLT-1A-Lys2-D4 variant 5 (inactivated) | SEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 233 | SLT-1A-Lys(null) variant 1 | REFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGRSYVMTAEDVDLTLNWGRLSSVL PDYHGQDSVRVGRISFGSINAILGSVALILNCHHHASRVAR |
| SEQ ID NO: 234 | SLT-1A-Lys(null) variant 2 | HEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 235 | SLT-1A-Lys(null) variant 3 | DEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 236 | SLT-1A-Lys(null) variant 4 | QEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 237 | SLT-1A-Lys(null) variant 5 | SEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 238 | SLT-1A-Lys(null) variant 6 | REFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 239 | SLT-1A-Lys(null) variant 7 | HEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 240 | SLT-1A-Lys(null) variant 8 | DEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 241 | SLT-1A-Lys(null) variant 9 | QEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 242 | SLT-1A-Lys(null) variant 10 | SEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 243 | SLT-1A-Lys(null) variant 11 | REFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |

-continued

| Sequence Listing | | |
|---|---|---|
| ID Number | Text Description | Biological Sequence |
| SEQ ID NO: 244 | SLT-1A-Lys(null) variant 12 | HEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 245 | SLT-1A-Lys(null) variant 13 | DEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 246 | SLT-1A-Lys(null) variant 14 | QEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 247 | SLT-1A-Lys(null) variant 15 | SEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 248 | SLT-1A-Lys(null) variant 16 | REFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 249 | SLT-1A-Lys(null) variant 17 | HEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 250 | SLT-1A-Lys(null) variant 18 | DEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 251 | SLT-1A-Lys(null) variant 19 | QEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 252 | SLT-1A-Lys(null) variant 20 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 253 | SLT-1A-Lys(null)-FR variant 1 | REFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 254 | SLT-1A-Lys(null)-FR variant 2 | HEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 255 | SLT-1A-<br>Lys(null)-FR<br>variant 3 | DEFTLDFSTARTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 256 | SLT-1A-<br>Lys(null)-FR<br>variant 4 | QEFTLDFSTARTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 257 | SLT-1A-<br>Lys(null)-FR<br>variant 5 | SEFTLDFSTARTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 258 | SLT-1A-<br>Lys(null)-FR<br>variant 6 | REFTLDFSTAHTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 259 | SLT-1A-<br>Lys(null)-FR<br>variant 7 | HEFTLDFSTAHTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 260 | SLT-1A-<br>Lys(null)-FR<br>variant 8 | DEFTLDFSTAHTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 261 | SLT-1A-<br>Lys(null)-FR<br>variant 9 | QEFTLDFSTAHTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 262 | SLT-1A-<br>Lys(null)-FR<br>variant 10 | SEFTLDFSTAHTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 263 | SLT-1A-<br>Lys(null)-FR<br>variant 11 | REFTLDFSTAQTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |
| SEQ ID NO: 264 | SLT-1A-<br>Lys(null)-FR<br>variant 12 | HEFTLDFSTAQTYVDSLNVIRSAIGTPLQTISSGGTSLLMIDSG<br>SGDNLFAVDVRGIDPEEGRFNNLRLIVERNNLYVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTAEAL<br>RFRQIQRGFRTTLDDLSGRSYVMTAEDVDLTLNWGRLSSVL<br>PDYHGQDSVRVGRISFGSINAILGSVALILNCHHHASAVAA |

-continued

Sequence Listing

| ID Number | Text Description | Biological Sequence |
|---|---|---|
| SEQ ID NO: 265 | SLT-1A-Lys(null)-FR variant 13 | DEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 266 | SLT-1A-Lys(null)-FR variant 14 | QEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 267 | SLT-1A-Lys(null)-FR variant 15 | SEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 268 | SLT-1A-Lys(null)-FR variant 16 | REFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 269 | SLT-1A-Lys(null)-FR variant 17 | HEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 270 | SLT-1A-Lys(null)-FR variant 18 | DEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 271 | SLT-1A-Lys(null)-FR variant 19 | QEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 272 | SLT-1A-Lys(null)-FR variant 20 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 273 | SLT-1A-Lys(null)-D1 variant 1 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 274 | SLT-1A-Lys(null)-D1 variant 2 | HEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 275 | SLT-1A-Lys(null)-D1 variant 3 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNCHHHASRVAR |
| SEQ ID NO: 276 | SLT-1A-Lys(null)-D1 variant 4 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 277 | SLT-1A-Lys(null)-D1 variant 5 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 278 | SLT-1A-Lys(null)-D1 variant 6 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 279 | SLT-1A-Lys(null)-D1 variant 7 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 280 | SLT-1A-Lys(null)-D1 variant 8 | DEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 281 | SLT-1A-Lys(null)-D1 variant 9 | QEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 282 | SLT-1A-Lys(null)-D1 variant 10 | SEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 283 | SLT-1A-Lys(null)-D1 variant 11 | REFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 284 | SLT-1A-Lys(null)-D1 variant 12 | HEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 285 | SLT-1A-Lys(null)-D1 variant 13 | DEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |

-continued

Sequence Listing

| ID Number | Text Description | Biological Sequence |
|---|---|---|
| SEQ ID NO: 286 | SLT-1A-Lys(null)-D1 variant 14 | QEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 287 | SLT-1A-Lys(null)-D1 variant 15 | SEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 288 | SLT-1A-Lys(null)-D1 variant 16 | REFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 289 | SLT-1A-Lys(null)-D1 variant 17 | HEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 290 | SLT-1A-Lys(null)-D1 variant 18 | DEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 291 | SLT-1A-Lys(null)-D1 variant 19 | QEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 292 | SLT-1A-Lys(null)-D1 variant 20 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSGTSLTQSVARAMLRFVTVTAEALRF RQIQRGFRTTLDDLSGASYVMTAEDVDLTLNWGRLSSVLPD YHGQDSVRVGRISFGSINAILGSVALILNCHHHASRVAR |
| SEQ ID NO: 293 | SLT-1A-Lys(null)-D2 variant 1 | HEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 294 | SLT-1A-Lys(null)-D2 variant 2 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 295 | SLT-1A-Lys(null)-D2 variant 3 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 296 | SLT-1A-Lys(null)-D2 variant 4 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNCHHHASRVAR |
| SEQ ID NO: 297 | SLT-1A-Lys(null)-D2 variant 5 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 298 | SLT-1A-Lys(null)-D2 variant 6 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 299 | SLT-1A-Lys(null)-D2 variant 7 | DEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 300 | SLT-1A-Lys(null)-D2 variant 8 | QEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 301 | SLT-1A-Lys(null)-D2 variant 9 | SEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 302 | SLT-1A-Lys(null)-D2 variant 10 | REFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 303 | SLT-1A-Lys(null)-D2 variant 11 | HEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 304 | SLT-1A-Lys(null)-D2 variant 12 | DEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 305 | SLT-1A-Lys(null)-D2 variant 13 | QEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 306 | SLT-1A-Lys(null)-D2 variant 14 | SEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |

-continued

Sequence Listing

| ID Number | Text Description | Biological Sequence |
|---|---|---|
| SEQ ID NO: 307 | SLT-1A-Lys(null)-D2 variant 15 | REFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 308 | SLT-1A-Lys(null)-D2 variant 16 | HEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 309 | SLT-1A-Lys(null)-D2 variant 17 | DEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 310 | SLT-1A-Lys(null)-D2 variant 18 | QEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 311 | SLT-1A-Lys(null)-D2 variant 19 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSATSLTQSVARAMLRFVTVTAEALRF RQIQRGFRTTLDDLSGASYVMTAEDVDLTLNWGRLSSVLPD YHGQDSVRVGRISFGSINAILGSVALILNCHHHASRVAR |
| SEQ ID NO: 312 | SLT-1A-Lys(null)-D2 variant 20 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSATSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 313 | SLT-1A-Lys(null)-D2 variant 21 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLALMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 314 | SLT-1A-Lys(null) variant 1 (inactivated) | REFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 315 | SLT-1A-Lys(null) variant 2 (inactivated) | HEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 316 | SLT-1A-Lys(null) variant 3 (inactivated) | DEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 317 | SLT-1A-Lys(null) variant 4 (inactivated) | QEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL |

-continued

Sequence Listing

| ID Number | Text Description | Biological Sequence |
|---|---|---|
| | | RFRQIQRGFRTTLDDLSGRSYVMTAEDVDLTLNWGRLSSVL PDYHGQDSVRVGRISFGSINAILGSVALILNCHHHASRVAR |
| SEQ ID NO: 318 | SLT-1A-Lys(null) variant 5 (inactivated) | SEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 319 | SLT-1A-Lys(null) variant 6 (inactivated) | REFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 320 | SLT-1A-Lys(null) variant 7 (inactivated) | HEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 321 | SLT-1A-Lys(null) variant 8 (inactivated) | DEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 322 | SLT-1A-Lys(null) variant 9 (inactivated) | QEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 323 | SLT-1A-Lys(null) variant 10 (inactivated) | SEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 324 | SLT-1A-Lys(null) variant 11 (inactivated) | REFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 325 | SLT-1A-Lys(null) variant 12 (inactivated) | HEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 326 | SLT-1A-Lys(null) variant 13 (inactivated) | DEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 327 | SLT-1A-Lys(null) variant 14 (inactivated) | QEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |

-continued

Sequence Listing

| ID Number | Text Description | Biological Sequence |
|---|---|---|
| SEQ ID NO: 328 | SLT-1A-Lys(null) variant 15 (inactivated) | SEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 329 | SLT-1A-Lys(null) variant 16 (inactivated) | REFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 330 | SLT-1A-Lys(null) variant 17 (inactivated) | HEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 331 | SLT-1A-Lys(null) variant 18 (inactivated) | DEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 332 | SLT-1A-Lys(null) variant 19 (inactivated) | QEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 333 | SLT-1A-Lys(null) variant 20 (inactivated) | SEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 334 | SLT-1A-Lys(null)-FR variant 1 (inactivated) | REFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 335 | SLT-1A-Lys(null)-FR variant 2 (inactivated) | HEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 336 | SLT-1A-Lys(null)-FR variant 3 (inactivated) | DEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 337 | SLT-1A-Lys(null)-FR variant 4 (inactivated) | QEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 338 | SLT-1A-Lys(null)-FR variant 5 (inactivated) | SEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL |

-continued

Sequence Listing

| ID Number | Text Description | Biological Sequence |
|---|---|---|
| | | RFRQIQRGFRTTLDDLSGRSYVMTAEDVDLTLNWGRLSSVL PDYHGQDSVRVGRISFGSINAILGSVALILNCHHHASAVAA |
| SEQ ID NO: 339 | SLT-1A-Lys(null)-FR variant 6 (inactivated) | REFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 340 | SLT-1A-Lys(null)-FR variant 7 (inactivated) | HEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 341 | SLT-1A-Lys(null)-FR variant 8 (inactivated) | DEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 342 | SLT-1A-Lys(null)-FR variant 9 (inactivated) | QEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 343 | SLT-1A-Lys(null)-FR variant 10 (inactivated) | SEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 344 | SLT-1A-Lys(null)-FR variant 11 (inactivated) | REFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 345 | SLT-1A-Lys(null)-FR variant 12 (inactivated) | HEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 346 | SLT-1A-Lys(null)-FR variant 13 (inactivated) | DEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 347 | SLT-1A-Lys(null)-FR variant 14 (inactivated) | QEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 348 | SLT-1A-Lys(null)-FR variant 15 (inactivated) | SEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |

-continued

Sequence Listing

| ID Number | Text Description | Biological Sequence |
|---|---|---|
| SEQ ID NO: 349 | SLT-1A-Lys(null)-FR variant 16 (inactivated) | REFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 350 | SLT-1A-Lys(null)-FR variant 17 (inactivated) | HEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 351 | SLT-1A-Lys(null)-FR variant 18 (inactivated) | DEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 352 | SLT-1A-Lys(null)-FR variant 19 (inactivated) | QEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 353 | SLT-1A-Lys(null)-FR variant 20 (inactivated) | SEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 354 | SLT-1A-Lys(null)-D1 variant 1 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 355 | SLT-1A-Lys(null)-D1 variant 2 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 356 | SLT-1A-Lys(null)-D1 variant 3 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 357 | SLT-1A-Lys(null)-D1 variant 4 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 358 | SLT-1A-Lys(null)-D1 variant 5 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 359 | SLT-1A-Lys(null)-D1 variant 6 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL |

-continued

| Sequence Listing | | |
|---|---|---|
| ID Number | Text Description | Biological Sequence |
| | | RFRQIQRGFRTTLDDLSGASYVMTAEDVDLTLNWGRLSSVL PDYHGQDSVRVGRISFGSINAILGSVALILNCHHHASRVAR |
| SEQ ID NO: 360 | SLT-1A-Lys(null)-D1 variant 7 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 361 | SLT-1A-Lys(null)-D1 variant 8 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 362 | SLT-1A-Lys(null)-D1 variant 9 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 363 | SLT-1A-Lys(null)-D1 variant 10 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 364 | SLT-1A-Lys(null)-D1 variant 11 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 365 | SLT-1A-Lys(null)-D1 variant 12 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 366 | SLT-1A-Lys(null)-D1 variant 13 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 367 | SLT-1A-Lys(null)-D1 variant 14 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 368 | SLT-1A-Lys(null)-D1 variant 15 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 369 | SLT-1A-Lys(null)-D1 variant 16 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |

-continued

Sequence Listing

| ID Number | Text Description | Biological Sequence |
| --- | --- | --- |
| SEQ ID NO: 370 | SLT-1A-Lys(null)-D1 variant 17 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 371 | SLT-1A-Lys(null)-D1 variant 18 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 372 | SLT-1A-Lys(null)-D1 variant 19 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 373 | SLT-1A-Lys(null)-D1 variant 20 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPD YHGQDSVRVGRISFGSINAILGSVALILNCHHHASRVAR |
| SEQ ID NO: 374 | SLT-1A-Lys(null)-D2 variant 1 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 375 | SLT-1A-Lys(null)-D2 variant 2 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 376 | SLT-1A-Lys(null)-D2 variant 3 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 377 | SLT-1A-Lys(null)-D2 variant 4 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 378 | SLT-1A-Lys(null)-D2 variant 5 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 379 | SLT-1A-Lys(null)-D2 variant 6 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 380 | SLT-1A-Lys(null)-D2 variant 7 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL |

-continued

| Sequence Listing | | |
|---|---|---|
| ID Number | Text Description | Biological Sequence |
| | | RFRQIQRGFRTTLDDLSGASYVMTAEDVDLTLNWGRLSSVL PDYHGQDSVRVGRISFGSINAILGSVALILNCHHHASRVAR |
| SEQ ID NO: 381 | SLT-1A-Lys(null)-D2 variant 8 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 382 | SLT-1A-Lys(null)-D2 variant 9 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 383 | SLT-1A-Lys(null)-D2 variant 10 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 384 | SLT-1A-Lys(null)-D2 variant 11 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 385 | SLT-1A-Lys(null)-D2 variant 12 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 386 | SLT-1A-Lys(null)-D2 variant 13 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 387 | SLT-1A-Lys(null)-D2 variant 14 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 388 | SLT-1A-Lys(null)-D2 variant 15 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 389 | SLT-1A-Lys(null)-D2 variant 16 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 390 | SLT-1A-Lys(null)-D2 variant 17 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |

-continued

Sequence Listing

| ID Number | Text Description | Biological Sequence |
|---|---|---|
| SEQ ID NO: 391 | SLT-1A-Lys(null)-D2 variant 18 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 392 | SLT-1A-Lys(null)-D2 variant 19 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSATSLTQSVARAMLRFVTVTADALRF RQIQRGFRTTLDDLSGASYVMTAEDVDLTLNWGRLSSVLPD YHGQDSVRVGRISFGSINAILGSVALILNCHHHASRVAR |
| SEQ ID NO: 393 | SLT-1A-Lys(null)-D2 variant 20 (inactivated) | SEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSATSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 394 | SLT-1A-Lys(null)-D2 variant 21 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLALMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASRVAR |
| SEQ ID NO: 395 | SLT-1A-Lys(null)-D3 variant 1 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 396 | SLT-1A-Lys(null)-D3 variant 2 | HEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 397 | SLT-1A-Lys(null)-D3 variant 3 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 398 | SLT-1A-Lys(null)-D3 variant 4 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 399 | SLT-1A-Lys(null)-D3 variant 5 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 400 | SLT-1A-Lys(null)-D3 variant 6 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 401 | SLT-1A-Lys(null)-D3 variant 7 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 402 | SLT-1A-<br>Lys(null)-D3<br>variant 8 | DEFTLDFSTAHTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 403 | SLT-1A-<br>Lys(null)-D3<br>variant 9 | QEFTLDFSTAHTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 404 | SLT-1A-<br>Lys(null)-D3<br>variant 10 | SEFTLDFSTAHTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 405 | SLT-1A-<br>Lys(null)-D3<br>variant 11 | REFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 406 | SLT-1A-<br>Lys(null)-D3<br>variant 12 | HEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 407 | SLT-1A-<br>Lys(null)-D3<br>variant 13 | DEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 408 | SLT-1A-<br>Lys(null)-D3<br>variant 14 | QEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 409 | SLT-1A-<br>Lys(null)-D3<br>variant 15 | SEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 410 | SLT-1A-<br>Lys(null)-D3<br>variant 16 | REFTLDFSTASTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |
| SEQ ID NO: 411 | SLT-1A-<br>Lys(null)-D3<br>variant 17 | HEFTLDFSTASTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNCHHHASAVAA |

-continued

Sequence Listing

| ID Number | Text Description | Biological Sequence |
|---|---|---|
| SEQ ID NO: 412 | SLT-1A-Lys(null)-D3 variant 18 | DEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 413 | SLT-1A-Lys(null)-D3 variant 19 | QEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 414 | SLT-1A-Lys(null)-D3 variant 20 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSGTSLTQSVARAMLRFVTVTAEALRF RQIQRGFRTTLDDLSGASYVMTAEDVDLTLNWGRLSSVLPD YHGQDSVRVGRISFGSINAILGSVALILNCHHHASAVAA |
| SEQ ID NO: 415 | SLT-1A-Lys(null)-D4 variant 1 | HEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 416 | SLT-1A-Lys(null)-D4 variant 2 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 417 | SLT-1A-Lys(null)-D4 variant 3 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 418 | SLT-1A-Lys(null)-D4 variant 4 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 419 | SLT-1A-Lys(null)-D4 variant 5 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 420 | SLT-1A-Lys(null)-D4 variant 6 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 421 | SLT-1A-Lys(null)-D4 variant 7 | DEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 422 | SLT-1A-Lys(null)-D4 variant 8 | QEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNCHHHASAVAA |
| SEQ ID NO: 423 | SLT-1A-Lys(null)-D4 variant 9 | SEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 424 | SLT-1A-Lys(null)-D4 variant 10 | REFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 425 | SLT-1A-Lys(null)-D4 variant 11 | HEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 426 | SLT-1A-Lys(null)-D4 variant 12 | DEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 427 | SLT-1A-Lys(null)-D4 variant 13 | QEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 428 | SLT-1A-Lys(null)-D4 variant 14 | SEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 429 | SLT-1A-Lys(null)-D4 variant 15 | REFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 430 | SLT-1A-Lys(null)-D4 variant 16 | HEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 431 | SLT-1A-Lys(null)-D4 variant 17 | DEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 432 | SLT-1A-Lys(null)-D4 variant 18 | QEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |

-continued

Sequence Listing

| ID Number | Text Description | Biological Sequence |
|---|---|---|
| SEQ ID NO: 433 | SLT-1A-Lys(null)-D4 variant 19 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSATSLTQSVARAMLRFVTVTAEALRF RQIQRGFRTTLDDLSGASYVMTAEDVDLTLNWGRLSSVLPD YHGQDSVRVGRISFGSINAILGSVALILNCHHHASAVAA |
| SEQ ID NO: 434 | SLT-1A-Lys(null)-D4 variant 20 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSATSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 435 | SLT-1A-Lys(null)-D4 variant 21 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLALMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 436 | SLT-1A-Lys(null)-D3 variant 1 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 437 | SLT-1A-Lys(null)-D3 variant 2 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 438 | SLT-1A-Lys(null)-D3 variant 3 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 439 | SLT-1A-Lys(null)-D3 variant 4 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 440 | SLT-1A-Lys(null)-D3 variant 5 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 441 | SLT-1A-Lys(null)-D3 variant 6 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 442 | SLT-1A-Lys(null)-D3 variant 7 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 443 | SLT-1A-Lys(null)-D3 variant 8 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL |

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNCHHHASAVAA |
| SEQ ID NO: 444 | SLT-1A-Lys(null)-D3 variant 9 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 445 | SLT-1A-Lys(null)-D3 variant 10 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 446 | SLT-1A-Lys(null)-D3 variant 11 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 447 | SLT-1A-Lys(null)-D3 variant 12 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 448 | SLT-1A-Lys(null)-D3 variant 13 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 449 | SLT-1A-Lys(null)-D3 variant 14 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 450 | SLT-1A-Lys(null)-D3 variant 15 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 451 | SLT-1A-Lys(null)-D3 variant 16 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 452 | SLT-1A-Lys(null)-D3 variant 17 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 453 | SLT-1A-Lys(null)-D3 variant 18 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |

-continued

| Sequence Listing | | |
|---|---|---|
| ID Number | Text Description | Biological Sequence |
| SEQ ID NO: 454 | SLT-1A-Lys(null)-D3 variant 19 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 455 | SLT-1A-Lys(null)-D3 variant 20 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPD YHGQDSVRVGRISFGSINAILGSVALILNCHHHASAVAA |
| SEQ ID NO: 456 | SLT-1A-Lys(null)-D4 variant 1 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 457 | SLT-1A-Lys(null)-D4 variant 2 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 458 | SLT-1A-Lys(null)-D4 variant 3 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 459 | SLT-1A-Lys(null)-D4 variant 4 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 460 | SLT-1A-Lys(null)-D4 variant 5 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 461 | SLT-1A-Lys(null)-D4 variant 6 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 462 | SLT-1A-Lys(null)-D4 variant 7 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 463 | SLT-1A-Lys(null)-D4 variant 8 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 464 | SLT-1A-Lys(null)-D4 variant 9 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNCHHHASAVAA |
| SEQ ID NO: 465 | SLT-1A-Lys(null)-D4 variant 10 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 466 | SLT-1A-Lys(null)-D4 variant 11 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 467 | SLT-1A-Lys(null)-D4 variant 12 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 468 | SLT-1A-Lys(null)-D4 variant 13 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 469 | SLT-1A-Lys(null)-D4 variant 14 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 470 | SLT-1A-Lys(null)-D4 variant 15 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 471 | SLT-1A-Lys(null)-D4 variant 16 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 472 | SLT-1A-Lys(null)-D4 variant 17 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 473 | SLT-1A-Lys(null)-D4 variant 18 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 474 | SLT-1A-Lys(null)-D4 variant 19 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSATSLTQSVARAMLRFVTVTADALRF RQIQRGFRTTLDDLSGASYVMTAEDVDLTLNWGRLSSVLPD YHGQDSVRVGRISFGSINAILGSVALILNCHHHASAVAA |

-continued

Sequence Listing

| ID Number | Text Description | Biological Sequence |
|---|---|---|
| SEQ ID NO: 475 | SLT-1A-Lys(null)-D4 variant 20 (inactivated) | SEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSATSLTQSVARAMLRFVTVTADAL RFRQIQRGFRTTLDDLSGRSYVMTAEDVDLTLNWGRLSSVL PDYHGQDSVRVGRISFGSINAILGSVALILNCHHHASAVAA |
| SEQ ID NO: 476 | SLT-1A-Lys(null)-D4 variant 21 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLALMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 477 | SLT-1A-Lys(null) variant 21 | REFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 478 | SLT-1A-Lys(null) variant 22 | HEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 479 | SLT-1A-Lys(null) variant 23 | DEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 480 | SLT-1A-Lys(null) variant 24 | QEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 481 | SLT-1A-Lys(null) variant 25 | SEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 482 | SLT-1A-Lys(null) variant 26 | REFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 483 | SLT-1A-Lys(null) variant 27 | HEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 484 | SLT-1A-Lys(null) variant 28 | DEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 485 | SLT-1A-Lys(null) variant 29 | QEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL |

-continued

Sequence Listing

| ID Number | Text Description | Biological Sequence |
| --- | --- | --- |
| | | RFRQIQRGFRTTLDDLSGRSYVMTAEDVDLTLNWGRLSSVL PDYHGQDSVRVGRISFGSINAILGSVALILNSHHHASRVAR |
| SEQ ID NO: 486 | SLT-1A-Lys(null) variant 30 | SEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 487 | SLT-1A-Lys(null) variant 31 | REFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 488 | SLT-1A-Lys(null) variant 32 | HEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 489 | SLT-1A-Lys(null) variant 33 | DEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 490 | SLT-1A-Lys(null) variant 34 | QEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 491 | SLT-1A-Lys(null) variant 35 | SEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 492 | SLT-1A-Lys(null) variant 36 | REFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 493 | SLT-1A-Lys(null) variant 37 | HEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 494 | SLT-1A-Lys(null) variant 38 | DEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 495 | SLT-1A-Lys(null) variant 39 | QEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |

-continued

Sequence Listing

| ID Number | Text Description | Biological Sequence |
|---|---|---|
| SEQ ID NO: 496 | SLT-1A-Lys(null) variant 40 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 497 | SLT-1A-Lys(null)-FR variant 21 | REFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 498 | SLT-1A-Lys(null)-FR variant 22 | HEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 499 | SLT-1A-Lys(null)-FR variant 23 | DEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 500 | SLT-1A-Lys(null)-FR variant 24 | QEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 501 | SLT-1A-Lys(null)-FR variant 25 | SEFTLDFSTARTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 502 | SLT-1A-Lys(null)-FR variant 26 | REFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 503 | SLT-1A-Lys(null)-FR variant 27 | HEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 504 | SLT-1A-Lys(null)-FR variant 28 | DEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 505 | SLT-1A-Lys(null)-FR variant 29 | QEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 506 | SLT-1A-Lys(null)-FR variant 30 | SEFTLDFSTAHTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL |

-continued

Sequence Listing

| ID Number | Text Description | Biological Sequence |
|---|---|---|
| | | RFRQIQRGFRTTLDDLSGRSYVMTAEDVDLTLNWGRLSSVL PDYHGQDSVRVGRISFGSINAILGSVALILNSHHHASAVAA |
| SEQ ID NO: 507 | SLT-1A-Lys(null)-FR variant 31 | REFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 508 | SLT-1A-Lys(null)-FR variant 32 | HEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 509 | SLT-1A-Lys(null)-FR variant 33 | DEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 510 | SLT-1A-Lys(null)-FR variant 34 | QEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 511 | SLT-1A-Lys(null)-FR variant 35 | SEFTLDFSTAQTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 512 | SLT-1A-Lys(null)-FR variant 36 | REFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 513 | SLT-1A-Lys(null)-FR variant 37 | HEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 514 | SLT-1A-Lys(null)-FR variant 38 | DEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 515 | SLT-1A-Lys(null)-FR variant 39 | QEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 516 | SLT-1A-Lys(null)-FR variant 40 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 517 | SLT-1A-Lys(null)-D1 variant 21 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 518 | SLT-1A-Lys(null)-D1 variant 22 | HEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 519 | SLT-1A-Lys(null)-D1 variant 23 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 520 | SLT-1A-Lys(null)-D1 variant 24 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 521 | SLT-1A-Lys(null)-D1 variant 25 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 522 | SLT-1A-Lys(null)-D1 variant 26 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 523 | SLT-1A-Lys(null)-D1 variant 27 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 524 | SLT-1A-Lys(null)-D1 variant 28 | DEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 525 | SLT-1A-Lys(null)-D1 variant 29 | QEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 526 | SLT-1A-Lys(null)-D1 variant 30 | SEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 527 | SLT-1A-Lys(null)-D1 variant 31 | REFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL |

-continued

| Sequence Listing | | |
|---|---|---|
| ID Number | Text Description | Biological Sequence |
| | | RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 528 | SLT-1A-<br>Lys(null)-D1<br>variant 32 | HEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 529 | SLT-1A-<br>Lys(null)-D1<br>variant 33 | DEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 530 | SLT-1A-<br>Lys(null)-D1<br>variant 34 | QEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 531 | SLT-1A-<br>Lys(null)-D1<br>variant 35 | SEFTLDFSTAQTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 532 | SLT-1A-<br>Lys(null)-D1<br>variant 36 | REFTLDFSTASTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 533 | SLT-1A-<br>Lys(null)-D1<br>variant 37 | HEFTLDFSTASTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 534 | SLT-1A-<br>Lys(null)-D1<br>variant 38 | DEFTLDFSTASTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 535 | SLT-1A-<br>Lys(null)-D1<br>variant 39 | QEFTLDFSTASTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |
| SEQ ID NO: 536 | SLT-1A-<br>Lys(null)-D1<br>variant 40 | SEFTLDFSTASTYVDSLNVIRSAIGTPLQTISSGGTSLLMIDSGI<br>GDNLFAVDILGFDFTLGRFNNLRLIVERNNLYVTGFVNRTNN<br>VFYRFADFSHVTFPGTTAVTLSADSSYTTLQRVAGISRTGMQ<br>INRHSLTTSYLDLMSHSGTSLTQSVARAMLRFVTVTAEALRF<br>RQIQRGFRTTLDDLSGASYVMTAEDVDLTLNWGRLSSVLPD<br>YHGQDSVRVGRISFGSINAILGSVALILNSHHHASRVAR |
| SEQ ID NO: 537 | SLT-1A-<br>Lys(null)-D2<br>variant 22 | HEFTLDFSTARTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSATSLTQSVARAMLRFVTVTAEAL<br>RFRQIQRGFRTTLDDLSGASYVMTAEDVDLTLNWGRLSSVL<br>PDYHGQDSVRVGRISFGSINAILGSVALILNSHHHASRVAR |

-continued

Sequence Listing

| ID Number | Text Description | Biological Sequence |
|---|---|---|
| SEQ ID NO: 538 | SLT-1A-Lys(null)-D2 variant 23 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 539 | SLT-1A-Lys(null)-D2 variant 24 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 540 | SLT-1A-Lys(null)-D2 variant 25 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 541 | SLT-1A-Lys(null)-D2 variant 26 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 542 | SLT-1A-Lys(null)-D2 variant 27 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 543 | SLT-1A-Lys(null)-D2 variant 28 | DEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 544 | SLT-1A-Lys(null)-D2 variant 29 | QEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 545 | SLT-1A-Lys(null)-D2 variant 30 | SEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 546 | SLT-1A-Lys(null)-D2 variant 31 | REFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 547 | SLT-1A-Lys(null)-D2 variant 32 | HEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 548 | SLT-1A-Lys(null)-D2 variant 33 | DEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL |

-continued

| Sequence Listing | | |
|---|---|---|
| ID Number | Text Description | Biological Sequence |
| | | RFRQIQRGFRTTLDDLSGASYVMTAEDVDLTLNWGRLSSVL PDYHGQDSVRVGRISFGSINAILGSVALILNSHHHASRVAR |
| SEQ ID NO: 549 | SLT-1A-Lys(null)-D2 variant 34 | QEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 550 | SLT-1A-Lys(null)-D2 variant 35 | SEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 551 | SLT-1A-Lys(null)-D2 variant 36 | REFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 552 | SLT-1A-Lys(null)-D2 variant 37 | HEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 553 | SLT-1A-Lys(null)-D2 variant 38 | DEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 554 | SLT-1A-Lys(null)-D2 variant 39 | QEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 555 | SLT-1A-Lys(null)-D2 variant 40 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSATSLTQSVARAMLRFVTVTAEALRF RQIQRGFRTTLDDLSGASYVMTAEDVDLTLNWGRLSSVLPD YHGQDSVRVGRISFGSINAILGSVALILNSHHHASRVAR |
| SEQ ID NO: 556 | SLT-1A-Lys(null)-D2 variant 41 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSATSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 557 | SLT-1A-Lys(null)-D2 variant 42 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLALMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 558 | SLT-1A-Lys(null) variant 21 (inactivated) | REFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |

-continued

Sequence Listing

| ID Number | Text Description | Biological Sequence |
|---|---|---|
| SEQ ID NO: 559 | SLT-1A-Lys(null) variant 22 (inactivated) | HEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 560 | SLT-1A-Lys(null) variant 23 (inactivated) | DEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 561 | SLT-1A-Lys(null) variant 24 (inactivated) | QEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 562 | SLT-1A-Lys(null) variant 25 (inactivated) | SEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 563 | SLT-1A-Lys(null) variant 26 (inactivated) | REFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 564 | SLT-1A-Lys(null) variant 27 (inactivated) | HEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 565 | SLT-1A-Lys(null) variant 28 (inactivated) | DEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 566 | SLT-1A-Lys(null) variant 29 (inactivated) | QEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 567 | SLT-1A-Lys(null) variant 30 (inactivated) | SEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 568 | SLT-1A-Lys(null) variant 31 (inactivated) | REFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 569 | SLT-1A-Lys(null) variant 32 (inactivated) | HEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL |

-continued

| Sequence Listing | | |
|---|---|---|
| ID Number | Text Description | Biological Sequence |
| | | RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 570 | SLT-1A-<br>Lys(null) variant<br>33 (inactivated) | DEFTLDFSTAQTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 571 | SLT-1A-<br>Lys(null) variant<br>34 (inactivated) | QEFTLDFSTAQTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 572 | SLT-1A-<br>Lys(null) variant<br>35 (inactivated) | SEFTLDFSTAQTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 573 | SLT-1A-<br>Lys(null) variant<br>36 (inactivated) | REFTLDFSTASTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 574 | SLT-1A-<br>Lys(null) variant<br>37 (inactivated) | HEFTLDFSTASTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 575 | SLT-1A-<br>Lys(null) variant<br>38 (inactivated) | DEFTLDFSTASTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 576 | SLT-1A-<br>Lys(null) variant<br>39 (inactivated) | QEFTLDFSTASTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 577 | SLT-1A-<br>Lys(null) variant<br>40 (inactivated) | SEFTLDFSTASTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASRVAR |
| SEQ ID NO: 578 | SLT-1A-<br>Lys(null)-FR<br>variant 21<br>(inactivated) | REFTLDFSTARTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |
| SEQ ID NO: 579 | SLT-1A-<br>Lys(null)-FR<br>variant 22<br>(inactivated) | HEFTLDFSTARTYVDSLNVIRSAIGTPLQTISSGGTSLLMIDSG<br>SGDNLFAVDVRGIDPEEGRFNNLRLIVERNNLSVTGFVNRTN<br>NVFYRFADFSHVTFPGTTAVTLSGDSSYTTLQRVAGISRTGM<br>QINRHSLTTSYLDLMSHSGTSLTQSVARAMLRFVTVTADAL<br>RFRQIQRGFRTTLDDLSGRSYVMTAEDVDLTLNWGRLSSVL<br>PDYHGQDSVRVGRISFGSINAILGSVALILNSHHHASAVAA |

-continued

Sequence Listing

| ID Number | Text Description | Biological Sequence |
|---|---|---|
| SEQ ID NO: 580 | SLT-1A-Lys(null)-FR variant 23 (inactivated) | DEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 581 | SLT-1A-Lys(null)-FR variant 24 (inactivated) | QEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 582 | SLT-1A-Lys(null)-FR variant 25 (inactivated) | SEFTLDFSTARTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 583 | SLT-1A-Lys(null)-FR variant 26 (inactivated) | REFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 584 | SLT-1A-Lys(null)-FR variant 27 (inactivated) | HEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 585 | SLT-1A-Lys(null)-FR variant 28 (inactivated) | DEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 586 | SLT-1A-Lys(null)-FR variant 29 (inactivated) | QEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 587 | SLT-1A-Lys(null)-FR variant 30 (inactivated) | SEFTLDFSTAHTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 588 | SLT-1A-Lys(null)-FR variant 31 (inactivated) | REFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 589 | SLT-1A-Lys(null)-FR variant 32 (inactivated) | HEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 590 | SLT-1A-Lys(null)-FR variant 33 (inactivated) | DEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL |

-continued

| Sequence Listing | | |
|---|---|---|
| ID Number | Text Description | Biological Sequence |
| | | RFRQIQRGFRTTLDDLSGRSYVMTAEDVDLTLNWGRLSSVL PDYHGQDSVRVGRISFGSINAILGSVALILNSHHHASAVAA |
| SEQ ID NO: 591 | SLT-1A-Lys(null)-FR variant 34 (inactivated) | QEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 592 | SLT-1A-Lys(null)-FR variant 35 (inactivated) | SEFTLDFSTAQTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 593 | SLT-1A-Lys(null)-FR variant 36 (inactivated) | REFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 594 | SLT-1A-Lys(null)-FR variant 37 (inactivated) | HEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 595 | SLT-1A-Lys(null)-FR variant 38 (inactivated) | DEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 596 | SLT-1A-Lys(null)-FR variant 39 (inactivated) | QEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 597 | SLT-1A-Lys(null)-FR variant 40 (inactivated) | SEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 598 | SLT-1A-Lys(null)-D1 variant 21 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 599 | SLT-1A-Lys(null)-D1 variant 22 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 600 | SLT-1A-Lys(null)-D1 variant 23 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |

-continued

| Sequence Listing | | |
|---|---|---|
| ID Number | Text Description | Biological Sequence |
| SEQ ID NO: 601 | SLT-1A-Lys(null)-D1 variant 24 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 602 | SLT-1A-Lys(null)-D1 variant 25 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 603 | SLT-1A-Lys(null)-D1 variant 26 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 604 | SLT-1A-Lys(null)-D1 variant 27 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 605 | SLT-1A-Lys(null)-D1 variant 28 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 606 | SLT-1A-Lys(null)-D1 variant 29 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 607 | SLT-1A-Lys(null)-D1 variant 30 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 608 | SLT-1A-Lys(null)-D1 variant 31 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 609 | SLT-1A-Lys(null)-D1 variant 32 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 610 | SLT-1A-Lys(null)-D1 variant 33 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 611 | SLT-1A-Lys(null)-D1 variant 34 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASRVAR |
| SEQ ID NO: 612 | SLT-1A-Lys(null)-D1 variant 35 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 613 | SLT-1A-Lys(null)-D1 variant 36 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 614 | SLT-1A-Lys(null)-D1 variant 37 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 615 | SLT-1A-Lys(null)-D1 variant 38 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 616 | SLT-1A-Lys(null)-D1 variant 39 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 617 | SLT-1A-Lys(null)-D1 variant 40 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPD YHGQDSVRVGRISFGSINAILGSVALILNSHHHASRVAR |
| SEQ ID NO: 618 | SLT-1A-Lys(null)-D2 variant 22 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 619 | SLT-1A-Lys(null)-D2 variant 23 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 620 | SLT-1A-Lys(null)-D2 variant 24 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 621 | SLT-1A-Lys(null)-D2 variant 25 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |

-continued

Sequence Listing

| ID Number | Text Description | Biological Sequence |
|---|---|---|
| SEQ ID NO: 622 | SLT-1A-Lys(null)-D2 variant 26 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 623 | SLT-1A-Lys(null)-D2 variant 27 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 624 | SLT-1A-Lys(null)-D2 variant 28 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 625 | SLT-1A-Lys(null)-D2 variant 29 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 626 | SLT-1A-Lys(null)-D2 variant 30 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 627 | SLT-1A-Lys(null)-D2 variant 31 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 628 | SLT-1A-Lys(null)-D2 variant 32 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 629 | SLT-1A-Lys(null)-D2 variant 33 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 630 | SLT-1A-Lys(null)-D2 variant 34 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 631 | SLT-1A-Lys(null)-D2 variant 35 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 632 | SLT-1A-Lys(null)-D2 variant 36 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASRVAR |
| SEQ ID NO: 633 | SLT-1A-Lys(null)-D2 variant 37 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 634 | SLT-1A-Lys(null)-D2 variant 38 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 635 | SLT-1A-Lys(null)-D2 variant 39 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 636 | SLT-1A-Lys(null)-D2 variant 40 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSATSLTQSVARAMLRFVTVTADALRF RQIQRGFRTTLDDLSGASYVMTAEDVDLTLNWGRLSSVLPD YHGQDSVRVGRISFGSINAILGSVALILNSHHHASRVAR |
| SEQ ID NO: 637 | SLT-1A-Lys(null)-D2 variant 41 (inactivated) | SEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSATSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 638 | SLT-1A-Lys(null)-D2 variant 42 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLALMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 639 | SLT-1A-Lys(null)-D3 variant 21 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 640 | SLT-1A-Lys(null)-D3 variant 22 | HEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 641 | SLT-1A-Lys(null)-D3 variant 23 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 642 | SLT-1A-Lys(null)-D3 variant 24 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 643 | SLT-1A-Lys(null)-D3 variant 25 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 644 | SLT-1A-Lys(null)-D3 variant 26 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 645 | SLT-1A-Lys(null)-D3 variant 27 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 646 | SLT-1A-Lys(null)-D3 variant 28 | DEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 647 | SLT-1A-Lys(null)-D3 variant 29 | QEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 648 | SLT-1A-Lys(null)-D3 variant 30 | SEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 649 | SLT-1A-Lys(null)-D3 variant 31 | REFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 650 | SLT-1A-Lys(null)-D3 variant 32 | HEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 651 | SLT-1A-Lys(null)-D3 variant 33 | DEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 652 | SLT-1A-Lys(null)-D3 variant 34 | QEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 653 | SLT-1A-Lys(null)-D3 variant 35 | SEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL |

-continued

| Sequence Listing | | |
|---|---|---|
| ID Number | Text Description | Biological Sequence |
| | | RFRQIQRGFRTTLDDLSGASYVMTAEDVDLTLNWGRLSSVL PDYHGQDSVRVGRISFGSINAILGSVALILNSHHHASAVAA |
| SEQ ID NO: 654 | SLT-1A-Lys(null)-D3 variant 36 | REFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 655 | SLT-1A-Lys(null)-D3 variant 37 | HEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 656 | SLT-1A-Lys(null)-D3 variant 38 | DEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 657 | SLT-1A-Lys(null)-D3 variant 39 | QEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 658 | SLT-1A-Lys(null)-D3 variant 40 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSGTSLTQSVARAMLRFVTVTAEALRF RQIQRGFRTTLDDLSGASYVMTAEDVDLTLNWGRLSSVLPD YHGQDSVRVGRISFGSINAILGSVALILNSHHHASAVAA |
| SEQ ID NO: 659 | SLT-1A-Lys(null)-D4 variant 22 | HEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 660 | SLT-1A-Lys(null)-D4 variant 23 | DEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 661 | SLT-1A-Lys(null)-D4 variant 24 | QEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 662 | SLT-1A-Lys(null)-D4 variant 25 | SEFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 663 | SLT-1A-Lys(null)-D4 variant 26 | REFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 664 | SLT-1A-Lys(null)-D4 variant 27 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 665 | SLT-1A-Lys(null)-D4 variant 28 | DEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 666 | SLT-1A-Lys(null)-D4 variant 29 | QEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 667 | SLT-1A-Lys(null)-D4 variant 30 | SEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 668 | SLT-1A-Lys(null)-D4 variant 31 | REFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 669 | SLT-1A-Lys(null)-D4 variant 32 | HEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 670 | SLT-1A-Lys(null)-D4 variant 33 | DEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 671 | SLT-1A-Lys(null)-D4 variant 34 | QEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 672 | SLT-1A-Lys(null)-D4 variant 35 | SEFTLDFSTAQTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 673 | SLT-1A-Lys(null)-D4 variant 36 | REFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 674 | SLT-1A-Lys(null)-D4 variant 37 | HEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL |

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASAVAA |
| SEQ ID NO: 675 | SLT-1A-Lys(null)-D4 variant 38 | DEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 676 | SLT-1A-Lys(null)-D4 variant 39 | QEFTLDFSTASTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 677 | SLT-1A-Lys(null)-D4 variant 40 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSATSLTQSVARAMLRFVTVTAEALRF RQIQRGFRTTLDDLSGASYVMTAEDVDLTLNWGRLSSVLPD YHGQDSVRVGRISFGSINAILGSVALILNSHHHASAVAA |
| SEQ ID NO: 678 | SLT-1A-Lys(null)-D4 variant 41 | SEFTLDFSTASTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSATSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 679 | SLT-1A-Lys(null)-D4 variant 42 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLALMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 680 | SLT-1A-Lys(null)-D3 variant 21 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 681 | SLT-1A-Lys(null)-D3 variant 22 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 682 | SLT-1A-Lys(null)-D3 variant 23 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 683 | SLT-1A-Lys(null)-D3 variant 24 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 684 | SLT-1A-Lys(null)-D3 variant 25 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 685 | SLT-1A-Lys(null)-D3 variant 26 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 686 | SLT-1A-Lys(null)-D3 variant 27 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 687 | SLT-1A-Lys(null)-D3 variant 28 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 688 | SLT-1A-Lys(null)-D3 variant 29 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 689 | SLT-1A-Lys(null)-D3 variant 30 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 690 | SLT-1A-Lys(null)-D3 variant 31 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 691 | SLT-1A-Lys(null)-D3 variant 32 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 692 | SLT-1A-Lys(null)-D3 variant 33 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 693 | SLT-1A-Lys(null)-D3 variant 34 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 694 | SLT-1A-Lys(null)-D3 variant 35 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 695 | SLT-1A-Lys(null)-D3 variant 36 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASAVAA |
| SEQ ID NO: 696 | SLT-1A-Lys(null)-D3 variant 37 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 697 | SLT-1A-Lys(null)-D3 variant 38 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 698 | SLT-1A-Lys(null)-D3 variant 39 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 699 | SLT-1A-Lys(null)-D3 variant 40 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPD YHGQDSVRVGRISFGSINAILGSVALILNSHHHASAVAA |
| SEQ ID NO: 700 | SLT-1A-Lys(null)-D4 variant 22 (inactivated) | HEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 701 | SLT-1A-Lys(null)-D4 variant 23 (inactivated) | DEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 702 | SLT-1A-Lys(null)-D4 variant 24 (inactivated) | QEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 703 | SLT-1A-Lys(null)-D4 variant 25 (inactivated) | SEFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 704 | SLT-1A-Lys(null)-D4 variant 26 (inactivated) | REFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 705 | SLT-1A-Lys(null)-D4 variant 27 (inactivated) | HEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 706 | SLT-1A-Lys(null)-D4 variant 28 (inactivated) | DEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 707 | SLT-1A-Lys(null)-D4 variant 29 (inactivated) | QEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 708 | SLT-1A-Lys(null)-D4 variant 30 (inactivated) | SEFTLDFSTAHTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 709 | SLT-1A-Lys(null)-D4 variant 31 (inactivated) | REFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 710 | SLT-1A-Lys(null)-D4 variant 32 (inactivated) | HEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 711 | SLT-1A-Lys(null)-D4 variant 33 (inactivated) | DEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 712 | SLT-1A-Lys(null)-D4 variant 34 (inactivated) | QEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 713 | SLT-1A-Lys(null)-D4 variant 35 (inactivated) | SEFTLDFSTAQTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 714 | SLT-1A-Lys(null)-D4 variant 36 (inactivated) | REFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 715 | SLT-1A-Lys(null)-D4 variant 37 (inactivated) | HEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 716 | SLT-1A-Lys(null)-D4 variant 38 (inactivated) | DEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL |

-continued

Sequence Listing

| ID Number | Text Description | Biological Sequence |
|---|---|---|
| | | RFRQIQRGFRTTLDDLSGASYVMTAEDVDLTLNWGRLSSVL PDYHGQDSVRVGRISFGSINAILGSVALILNSHHHASAVAA |
| SEQ ID NO: 717 | SLT-1A-Lys(null)-D4 variant 39 (inactivated) | QEFTLDFSTASTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 718 | SLT-1A-Lys(null)-D4 variant 40 (inactivated) | SEFTLDFSTASTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSATSLTQSVARAMLRFVTVTADALRF RQIQRGFRTTLDDLSGASYVMTAEDVDLTLNWGRLSSVLPD YHGQDSVRVGRISFGSINAILGSVALILNSHHHASAVAA |
| SEQ ID NO: 719 | SLT-1A-Lys(null)-D4 variant 41 (inactivated) | SEFTLDFSTASTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSATSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 720 | SLT-1A-Lys(null)-D4 variant 42 (inactivated) | REFTLDFSTARTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLALMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 721 | SLT-1A-Cys(null) variant 1 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 722 | SLT-1A-Cys(null)-FR variant 1 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNSHHHASAVAA |
| SEQ ID NO: 723 | SLT-1A-Cys(null)-D1 variant 1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 724 | SLT-1A-Cys(null)-D2 variant 1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 725 | SLT-1A-Cys(null) variant 1 (inactivated) | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASRVAR |
| SEQ ID NO: 726 | SLT-1A-Cys(null)-FR variant 1 (inactivated) | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNSHHHASAVAA |

-continued

Sequence Listing

| ID Number | Text Description | Biological Sequence |
|---|---|---|
| SEQ ID NO: 727 | SLT-1A-Cys(null)-D1 variant 1 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 728 | SLT-1A-Cys(null)-D2 variant 1 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 729 | SLT-1A-Cys(null)-D3 variant 1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 730 | SLT-1A-Cys(null)-D4 variant 1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 731 | SLT-1A-Cys(null)-D3 (inactivated) variant 1 | kEFTLDFSTAKTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPD YHGQDSVRVGRISFGSINAILGSVALILNSHHHASAVAA |
| SEQ ID NO: 732 | SLT-1A-Cys(null)-D4 variant 1 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 733 | SLT-1A-Cys(null) variant 2 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNAHHHASRVAR |
| SEQ ID NO: 734 | SLT-1A-Cys(null)-FR variant 2 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNAHHHASAVAA |
| SEQ ID NO: 735 | SLT-1A-Cys(null)-D1 variant 2 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNAHHHASRVAR |
| SEQ ID NO: 736 | SLT-1A-Cys(null)-D2 variant 2 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNAHHHASRVAR |
| SEQ ID NO: 737 | SLT-1A-Cys(null) variant 2 (inactivated) | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL |

-continued

| Sequence Listing | | |
|---|---|---|
| ID Number | Text Description | Biological Sequence |
| | | RFRQIQRGFRTTLDDLSGRSYVMTAEDVDLTLNWGRLSSVL PDYHGQDSVRVGRISFGSINAILGSVALILNAHHHASRVAR |
| SEQ ID NO: 738 | SLT-1A-Cys(null)-FR variant 2 (inactivated) | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNAHHHASAVAA |
| SEQ ID NO: 739 | SLT-1A-Cys(null)-D1 variant 2 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNAHHHASRVAR |
| SEQ ID NO: 740 | SLT-1A-Cys(null)-D2 variant 2 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNAHHHASRVAR |
| SEQ ID NO: 741 | SLT-1A-Cys(null)-D3 variant 2 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNAHHHASAVAA |
| SEQ ID NO: 742 | SLT-1A-Cys(null)-D4 variant 2 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNAHHHASAVAA |
| SEQ ID NO: 743 | SLT-1A-Cys(null)-D3 (inactivated) variant 2 | kEFTLDFSTAKTYVDSLNVIRSAIGTPLQTISSGGTSLLMIDSGI GDNLFAVDILGFDFTLGRFNNLRLIVERNNLSVTGFVNRTNN VFYRFADFSHVTFPGTTAVTLSADSSYTTLQRVAGISRTGMQ INRHSLTTSYLDLMSHSGTSLTQSVARAMLRFVTVTADALRF RQIQRGFRTTLDDLSGASYVMTAEDVDLTLNWGRLSSVLPD YHGQDSVRVGRISFGSINAILGSVALILNAHHHASAVAA |
| SEQ ID NO: 744 | SLT-1A-Cys(null)-D4 variant 2 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNAHHHASAVAA |
| SEQ ID NO: 745 | SLT-1A-Cys(null) variant 3 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNVHHHASRVAR |
| SEQ ID NO: 746 | SLT-1A-Cys(null)-FR variant 3 | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNVHHHASRVAR |
| SEQ ID NO: 747 | SLT-1A-Cys(null)-D1 variant 3 | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNVHHHASAVAA |

-continued

Sequence Listing

| ID Number | Text Description | Biological Sequence |
|---|---|---|
| SEQ ID NO: 748 | SLT-1A-Cys(null)-D2 variant 3 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNVHHHASRVAR |
| SEQ ID NO: 749 | SLT-1A-Cys(null) variant 3 (inactivated) | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNVHHHASRVAR |
| SEQ ID NO: 750 | SLT-1A-Cys(null)-FR variant 3 (inactivated) | KEFTLDFSTAKTYVDSLNVIRSAIGTPLQTISSGGTSLLMIDSG SGDNLFAVDVRGIDPEEGRFNNLRLIVERNNLSVTGFVNRTN NVFYRFADFSHVTFPGTTAVTLSGDSSYTTLQRVAGISRTGM QINRHSLTTSYLDLMSHSGTSLTQSVARAMLRFVTVTADAL RFRQIQRGFRTTLDDLSGRSYVMTAEDVDLTLNWGRLSSVL PDYHGQDSVRVGRISFGSINAILGSVALILNVHHHASAVAA |
| SEQ ID NO: 751 | SLT-1A-Cys(null)-D1 variant 3 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNVHHHASRVAR |
| SEQ ID NO: 752 | SLT-1A-Cys(null)-D2 variant 3 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNVHHHASRVAR |
| SEQ ID NO: 753 | SLT-1A-Cys(null)-D3 variant 3 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNVHHHASAVAA |
| SEQ ID NO: 754 | SLT-1A-Cys(null)-D4 variant 3 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNVHHHASAVAA |
| SEQ ID NO: 755 | SLT-1A-Cys(null)-D3 (inactivated) variant 3 | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNVHHHASAVAA |
| SEQ ID NO: 756 | SLT-1A-Cys(null)-D4 variant 3 (inactivated) | KEFTLDFSTAKTYVDSLNVIRSAIGTPLQTISSGGTSLLMIDSG IGDNLFAVDILGFDFTLGRFNNLRLIVERNNLSVTGFVNRTN NVFYRFADFSHVTFPGTTAVTLSADSSYTTLQRVAGISRTGM QINRHSLTTSYLDLMSHSATSLTQSVARAMLRFVTVTADAL RFRQIQRGFRTTLDDLSGASYVMTAEDVDLTLNWGRLSSVL PDYHGQDSVRVGRISFGSINAILGSVALILNVHHHASAVAA |
| SEQ ID NO: 757 | linker-Cys1 | EFPKPCTPPGSSGGAP |
| SEQ ID NO: 758 | linker-Cys2 | EFPKPSTPPGSCGGAP |
| SEQ ID NO: 759 | linker-Cys3 | AHHCEDPSSKAPKAP |
| SEQ ID NO: 760 | linker-Cys4 | AHHSEDPSCKAPKAP |
| SEQ ID NO: 761 | linker-Lys1 | EFPKPSTPPGSSGGAP |

Sequence Listing

| ID Number | Text Description | Biological Sequence |
|---|---|---|
| SEQ ID NO: 762 | SLT-1A-Cys(null)-scaffold variant 1 C257 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAAE FPKPCTPPGSSGGAP |
| SEQ ID NO: 763 | SLT-1A-Cys(null)-scaffold variant 2 C257 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAAE FPKPCTPPGSSGGAP |
| SEQ ID NO: 764 | SLT-1A-Lys(null)-scaffold variant 1 K255 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAAE FPKPSTPPGSSGGAP |
| SEQ ID NO: 765 | SLT-1A-Lys(null)-scaffold variant 2 K255 | HEFTLDFSTAHTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAAE FPKPSTPPGSSGGAP |
| SEQ ID NO: 766 | SLT-1A-Lys(null)-scaffold variant 3 K255 | SEFTLDFSTASTYVDSLNVIRSAIGTPLQTISSGGTSLLMIDSGI GDNLFAVDILGFDFTLGRFNNLRLIVERNNLYVTGFVNRTNN VFYRFADFSHVTFPGTTAVTLSADSSYTTLQRVAGISRTGMQ INRHSLTTSYLDLMSHSGTSLTQSVARAMLRFVTVTAEALRF RQIQRGFRTTLDDLSGASYVMTAEDVDLTLNWGRLSSVLPD YHGQDSVRVGRISFGSINAILGSVALILNSHHHASAVAAEFP KPSTPPGSSGGAP |
| SEQ ID NO: 767 | SLT-1A-Lys(null)-scaffold variant 4 K255 | REFTLDFSTARTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAAE FPKPSTPPGSSGGAP |
| SEQ ID NO: 768 | linker-IgA hinge | SPSTPPTPSPSTPPAS |
| SEQ ID NO: 769 | scFv-linker-Cys1 | GGGGC |
| SEQ ID NO: 770 | scFv-linker-Cys2 | GGGGSGGGGSGGGGCGGGGSGGGGS |
| SEQ ID NO: 771 | scFv-linker-Cys3 | GSTSGCGKPGSGEGS |
| SEQ ID NO: 772 | scFv-linker-Cys4 | GSTSGCGKPGSGEGSTKG |
| SEQ ID NO: 773 | cell-targeting molecule 1 | MKEFTLDFCTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 774 | cell-targeting molecule 2 | MKEFTLDFSTAKTYVDSLNVIRSAIGTPLQTISSGGTSLLMID CGIGDNLFAVDILGFDFTLGRFNNLRLIVERNNLYVTGFVNR TNNVFYRFADFSHVTFPGTTAVTLSADSSYTTLQRVAGISRT |

-continued

Sequence Listing

| ID Number | Text Description | Biological Sequence |
|---|---|---|
| | | GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 775 | cell-targeting molecule 3 | MKEFTLDFSTAKTYVDSLNVIRSAIGTPLQTISSGGTSLLMID SGCGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 776 | cell-targeting molecule 4 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHCGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 777 | cell-targeting molecule 5 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLCGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 778 | cell-targeting molecule 6 | MKEFTLDFSTAKTYVDSLNVIRSAIGTPLQTISCGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIVLTQSPASLAVSLGQRATISCRAT ESVEYYGTSLVQWYQQKPGQPPKLLIYAASSVDSGVPARFS GSGSGTDFSLTIHPVEEDDIAMYFCQQSRRVPYTFGGGTKLEI KGGGGSGGGGSGGGGSGGGGSGGGGSEVQLQQSGPELVKP GASVKMSCKASGYTFTSYVMHWVKQKPGQGLEWIGYVNP FNDGTKYNEMFKGKATLTSDKSSSTAYMELSSLTSEDSAVY YCARQAWGYPWGQGTLVTVSA |
| SEQ ID NO: 779 | cell-targeting molecule 7 | MKEFTLDFSTAKTYVDCLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIVLTQSPASLAVSLGQRATISCRAT ESVEYYGTSLVQWYQQKPGQPPKLLIYAASSVDSGVPARFS GSGSGTDFSLTIHPVEEDDIAMYFCQQSRRVPYTFGGGTKLEI KGGGGSGGGGSGGGGSGGGGSGGGGSEVQLQQSGPELVKP |

-continued

Sequence Listing

| ID Number | Text Description | Biological Sequence |
|---|---|---|
| | | GASVKMSCKASGYTFTSYVMHWVKQKPGQGLEWIGYVNP FNDGTKYNEMFKGKATLTSDKSSSTAYMELSSLTSEDSAVY YCARQAWGYPWGQGTLVTVSA |
| SEQ ID NO: 780 | cell-targeting molecule 8 | MKEFTLDFCTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIVLTQSPASLAVSLGQRATISCRAT ESVEYYGTSLVQWYQQKPGQPPKLLIYAASSVDSGVPARFS GSGSGTDFSLTIHPVEEDDIAMYFCQQSRRVPYTFGGGTKLEI KGGGGSGGGGSGGGGSGGGGSGGGGSEVQLQQSGPELVKP GASVKMSCKASGYTFTSYVMHWVKQKPGQGLEWIGYVNP FNDGTKYNEMFKGKATLTSDKSSSTAYMELSSLTSEDSAVY YCARQAWGYPWGQGTLVTVSA |
| SEQ ID NO: 781 | cell-targeting molecule 9 | MKEFTLDFSTAKTYVDSLNVIRSAIGTPLQTISCGGTSLLMID SGSGDNLFAVDVRGIDPEEGRFNNLRLIVERNNLYVTGFVNR TNNVFYRFADFSHVTFPGTTAVTLSGDSSYTTLQRVAGISRT GMQINRHSLTTSYLDLMSHSGTSLTQSVARAMLRFVTVTAE ALRFRQIQRGFRTTLDDLSGRSYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITVRAS QDVNTAVAWYQQKPGKAPKLLIYSASFLYSGVPSRFSGSRS GTDFTLTISSLQPEDFATYYAQQHYTTPPTFGQGTKVEIKRTG STSGSGKPGSGEGSEVQLVESGGGLVQPGGSLRLSVAASGFN IKDTYIHWVRQAPGKGLEWVARIYPTNGYTRYADSVKGRFT ISADTSKNTAYLQMNSLRAEDTAVYYASRWGGDGFYAMDV WGQGTLVTVSSA |
| SEQ ID NO: 782 | cell-targeting molecule 10 | MKEFTLDFSTAKTYVDSLNVIRSAIGTPLQTISSGGTSLLMID SGCGDNLFAVDVRGIDPEEGRFNNLRLIVERNNLYVTGFVN RTNNVFYRFADFSHVTFPGTTAVTLSGDSSYTTLQRVAGISR TGMQINRHSLTTSYLDLMSHSGTSLTQSVARAMLRFVTVTA EALRFRQIQRGFRTTLDDLSGRSYVMTAEDVDLTLNWGRLS SVLPDYHGQDSVRVGRISFGSINAILGSVALILNSHHHASAV AAEFPKPSTPPGSSGGAPDIQMTQSPSSLSASVGDRVTITVRA SQDVNTAVAWYQQKPGKAPKLLIYSASFLYSGVPSRFSGSR SGTDFTLTISSLQPEDFATYYAQQHYTTPPTFGQGTKVEIKRT GSTSGSGKPGSGEGSEVQLVESGGGLVQPGGSLRLSVAASGF NIKDTYIHWVRQAPGKGLEWVARIYPTNGYTRYADSVKGRF TISADTSKNTAYLQMNSLRAEDTAVYYASRWGGDGFYAMD VWGQGTLVTVSSA |
| SEQ ID NO: 783 | cell-targeting molecule 11 | MKEFTLDFSTAKTYVDSLNVIRSAIGTPLQTISSGGTSLLMID SGSGDNLFAVDCRGIDPEEGRFNNLRLIVERNNLYVTGFVNR TNNVFYRFADFSHVTFPGTTAVTLSGDSSYTTLQRVAGISRT GMQINRHSLTTSYLDLMSHSGTSLTQSVARAMLRFVTVTAE ALRFRQIQRGFRTTLDDLSGRSYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITVRAS QDVNTAVAWYQQKPGKAPKLLIYSASFLYSGVPSRFSGSRS GTDFTLTISSLQPEDFATYYAQQHYTTPPTFGQGTKVEIKRTG STSGSGKPGSGEGSEVQLVESGGGLVQPGGSLRLSVAASGFN IKDTYIHWVRQAPGKGLEWVARIYPTNGYTRYADSVKGRFT ISADTSKNTAYLQMNSLRAEDTAVYYASRWGGDGFYAMDV WGQGTLVTVSSA |
| SEQ ID NO: 784 | cell-targeting molecule 12 | MEIVLTQSPATLSLSPGERATLSCRASQSVSSYLAWYQQKPG QAPRLLIYDASNRATGIPARFSGSGSGTDFTLTISSLEPEDFAV YYCQQRSDWPLTFGGGTKVEIKGSTSGSGKPGSGEGSAVQL VESGGGLVQPGRSLRLSCAASGFTFGDYTMHWVRQAPGKG LEWVSGISWNSGSIGYADSVKGRFTISRDNAKNSLYLQMNS LRAEDTALYYCTKDNQYGSGSTYGLGVWGQGTLVTVSSEF PKPSTPPGSSGGAPKEFTLDFCTAKTYVDSLNVIRSAIGTPLQ TISSGGTSLLMIDSGIGDNLFAVDILGFDFTLGRFNNLRLIVER NNLYVTGFVNRTNNVFYRFADFSHVTFPGTTAVTLSADSSY TTLQRVAGISRTGMQINRHSLTTSYLDLMSHSATSLTQSVAR AMLRFVTVTAEALRFRQIQRGFRTTLDDLSGASYVMTAEDV DLTLNWGRLSSVLPDYHGQDSVRVGRISFGSINAILGSVALIL NSHHHASRVAR |

-continued

Sequence Listing

| ID Number | Text Description | Biological Sequence |
|---|---|---|
| SEQ ID NO: 785 | cell-targeting molecule 13 | MEIVLTQSPATLSLSPGERATLSCRASQSVSSYLAWYQQKPG QAPRLLIYDASNRATGIPARFSGSGSGTDFTLTISSLEPEDFAV YYCQQRSDWPLTFGGGTKVEIKGSTSGSGKPGSGEGSAVQL VESGGGLVQPGRSLRLSCAASGFTFGDYTMHWVRQAPGKG LEWVSGISWNSGSIGYADSVKGRFTISRDNAKNSLYLQMNS LRAEDTALYYCTKDNQYGSGSTYGLGVWGQGTLVTVSSEF PKPSTPPGSSGGAPKEFTLDFSTAKTYVDSLNVIRSAIGTPLQ TISSGGTSLLMIDCGIGDNLFAVDILGFDFTLGRFNNLRLIVER NNLYVTGFVNRTNNVFYRFADFSHVTFPGTTAVTLSADSSY TTLQRVAGISRTGMQINRHSLTTSYLDLMSHSATSLTQSVAR AMLRFVTVTAEALRFRQIQRGFRTTLDDLSGASYVMTAEDV DLTLNWGRLSSVLPDYHGQDSVRVGRISFGSINAILGSVALIL NSHHHASRVAR |
| SEQ ID NO: 786 | cell-targeting molecule 14 | MEIVLTQSPATLSLSPGERATLSCRASQSVSSYLAWYQQKPG QAPRLLIYDASNRATGIPARFSGSGSGTDFTLTISSLEPEDFAV YYCQQRSDWPLTFGGGTKVEIKGSTSGSGKPGSGEGSAVQL VESGGGLVQPGRSLRLSCAASGFTFGDYTMHWVRQAPGKG LEWVSGISWNSGSIGYADSVKGRFTISRDNAKNSLYLQMNS LRAEDTALYYCTKDNQYGSGSTYGLGVWGQGTLVTVSSEF PKPSTPPGSSGGAPKEFTLDFSTAKTYVDSLNVIRSAIGTPLQ TISSGGTSLLMIDSGIGDNLFAVDILGFDFTLGRFNNLRLIVER NNLYVTGFVNRTNNVFYRFADFSHVTFPGTTAVTLSADSSY TTLQRVAGISRTGMQINRHSLTTSYLDLMSHCATSLTQSVAR AMLRFVTVTAEALRFRQIQRGFRTTLDDLSGASYVMTAEDV DLTLNWGRLSSVLPDYHGQDSVRVGRISFGSINAILGSVALIL NSHHHASRVAR |
| SEQ ID NO: 787 | cell-targeting molecule 15 | MEIVLTQSPATLSLSPGERATLSCRASQSVSSYLAWYQQKPG QAPRLLIYDASNRATGIPARFSGSGSGTDFTLTISSLEPEDFAV YYCQQRSDWPLTFGGGTKVEIKGSTSGSGKPGSGEGSAVQL VESGGGLVQPGRSLRLSCAASGFTFGDYTMHWVRQAPGKG LEWVSGISWNSGSIGYADSVKGRFTISRDNAKNSLYLQMNS LRAEDTALYYCTKDNQYGSGSTYGLGVWGQGTLVTVSSEF PKPSTPPGSSGGAPKEFTLDFSTAKTYVDSLNVIRSAIGTPLQ TISSGGTSLLMIDSGIGDNLFAVDILGFDFTLGRFNNLRLIVER NNLYVTGFVNRTNNVFYRFADFSHVTFPGTTAVTLSADSSY TTLQRVAGISRTGMQINRHSLTTSYLDLMSHSATSLTQSVAR AMLRFVTVTAEALRFRQIQRGFRTTLDDLCGASYVMTAEDV DLTLNWGRLSSVLPDYHGQDSVRVGRISFGSINAILGSVALIL NSHHHASRVAR |
| SEQ ID NO: 788 | cell-targeting molecule 16 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLCGASYVMTAEDVDLTLNWGRLSS VLPDYHGQDSVRVGRISFGSINAILGSVALILNSHHHASAVA AAHHSEDPSSKAPKAPEVQLVESGGGLVQAGGSLRLSCAAS GITFSINTMGWYRQAPGKQRELVALISSIGDTYYADSVKGRF TISRDNAKNTVYLQMNSLKPEDTAVYYCKRFRTAAQGTDY WGQGTQVTVSSA |
| SEQ ID NO: 789 | cell-targeting molecule 17 | MKEFTLDFSTAKTYVDSLNVIRSAIGTPLQTISCGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 790 | cell-targeting molecule 18 | MKEFTLDFSTAKTYVDSLNVIRSAIGTPLQTISSGGTSLLMID CGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG |

-continued

Sequence Listing

| ID Number | Text Description | Biological Sequence |
|---|---|---|
| | | TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 791 | cell-targeting molecule 19 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHCGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 792 | cell-targeting molecule 20 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLCGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 793 | cell-targeting molecule 21 | MKEFTLDFSTAKTYVDSLNVIRSAIGTPLQTISSGGTSLLMID SGCGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 794 | cell-targeting molecule 22 | MKEFTLDFCTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 795 | cell-targeting molecule 23 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHCGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 796 | cell-targeting molecule 24 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT |

-continued

Sequence Listing

| ID Number | Text Description | Biological Sequence |
|---|---|---|
| | | GMQINRHSLTTSYLDLMSHSGTSLTQSVARAMLRFVTVTAE ALRFRQIQRGFRTTLDDLCGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 797 | cell-targeting molecule 25 | MKEFTLDFSTAKTYVDSLNVIRSAIGTPLQTISSGGTSLLMID SGCGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 798 | cell-targeting molecule 26 | MKEFTLDFCTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 799 | cell-targeting molecule 27 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHCGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 800 | cell-targeting molecule 28 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLCGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 801 | cell-targeting molecule 29 | MKEFTLDFSTAKTYVDSLNVIRSAIGTPLQTISSGGTSLLMID SGCGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG |

-continued

Sequence Listing

| ID Number | Text Description | Biological Sequence |
| --- | --- | --- |
| | | TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 802 | cell-targeting molecule 30 | MKEFTLDFSTAKTYVDSLNVIRCAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 803 | cell-targeting molecule 31 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPCTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 804 | cell-targeting molecule 32 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPCTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 805 | cell-targeting molecule 33 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPCTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 806 | cell-targeting molecule 34 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPCTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 807 | cell-targeting molecule 35 | MKEFTLDFSTAKTYVDSLNVIRSAIGTPLQTISSGGTSLLMID SGIGDNLFAVDILGFDFTLGRFNNLRLIVERNNLYVTGFVNR |

-continued

| Sequence Listing | | |
|---|---|---|
| ID Number | Text Description | Biological Sequence |
| | | TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GCQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 808 | cell-targeting molecule 36 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GCQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 809 | cell-targeting molecule 37 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGCGGGGSGGGGSQVQLQESGPGLVRPSQTL SLTCTVSGFSLTSYGVHWVRQPPGRGLEWIGVMWRGGSTD YNAAFMSRLNITKDNSKNQVSLRLSSVTAADTAVYYCAKS MITTGFVMDSWGQGSLVTVSS |
| SEQ ID NO: 810 | cell-targeting molecule 38 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGCGGGGSGGGGSQVQLQESGPGLVRPSQTL SLTCTVSGFSLTSYGVHWVRQPPGRGLEWIGVMWRGGSTD YNAAFMSRLNITKDNSKNQVSLRLSSVTAADTAVYYCAKS MITTGFVMDSWGQGSLVTVSS |
| SEQ ID NO: 811 | cell-targeting molecule 39 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGCGGGGSGGGGSQVQLQESGPGLVRPSQTL SLTCTVSGFSLTSYGVHWVRQPPGRGLEWIGVMWRGGSTD YNAAFMSRLNITKDNSKNQVSLRLSSVTAADTAVYYCAKS MITTGFVMDSWGQGSLVTVSS |
| SEQ ID NO: 812 | cell-targeting molecule 40 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG |

-continued

Sequence Listing

| ID Number | Text Description | Biological Sequence |
|---|---|---|
| | | GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVCS |
| SEQ ID NO: 813 | cell-targeting molecule 41 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVCS |
| SEQ ID NO: 814 | cell-targeting molecule 42 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVCS |
| SEQ ID NO: 815 | cell-targeting molecule 43 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVCS |
| SEQ ID NO: 816 | cell-targeting molecule 44 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AAHHSEDPSSKAPKAPEVQLVESGGGLVQAGGSLRLSCAAS GITFSINTMGWYRQAPGKQRELVALISSIGDTYYADSVKGRF TISRDNAKNTVYLQMNSLKPEDTAVYYCKRFRTAAQGTDY WGQGTQVTVSCA |
| SEQ ID NO: 817 | cell-targeting molecule 45 | MKEFTLDFSTAKTYVDSLNVIRSAIGTPLQTISSGGTSLLMID SGIGDNLFAVDILGFDFTLGRFNNLRLIVERNNLSVTGFVNRT NNVFYRFADFSHVTFPGTTAVTLSADSSYTTLQRVAGISRTG MQINRHSLTTSYLDLMSHSGTSLTQSVARAMLRFVTVTADA LRFRQIQRGFRTTLDDLSGASYVMTAEDVDLTLNWGRLSSV LPDYHGQDSVRVGRISFGSINAILGSVALILNSHHHASAVAA AHHSEDPSSKAPKAPEVQLVESGGGLVQAGGSLRLSCAASGI TFSINTMGWYRQAPGKQRELVALISSIGDTYYADSVKGRFTI SRDNAKNTVYLQMNSLKPEDTAVYYCKRFRTAAQGTDYW GQGTQVTVSCA |
| SEQ ID NO: 818 | cell-targeting molecule 46 | MKEFTLDFSTARTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPQVQLQQSGPELKKPGETVKISCKAS GYPFTNYGMNWVKQAPGQGLKWMGWINTSTGESTFADDF |

-continued

| Sequence Listing | | |
|---|---|---|
| ID Number | Text Description | Biological Sequence |
| | | KGRFDFSLETSANTAYLQINNLKSEDSATYFCARWEVYHGY VPYWGQGTTVTVSSGGGGSGGGGSGGGGSGGGGSGGGGS DIQMTQSPSSLSASVGDRVTITCKASQDVYNAVAWYQQKPG QSPKLLIYSASSRYTGVPSRFTGSGSGPDFTFTISSVQAEDLA VYFCQQHFRTPFTFGSGTKLEIK |
| SEQ ID NO: 819 | cell-targeting molecule 47 | MKEFTLDFSTAHTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPQVQLQQSGPELKKPGETVKISCKAS GYPFTNYGMNWVKQAPGQGLKWMGWINTSTGESTFADDF KGRFDFSLETSANTAYLQINNLKSEDSATYFCARWEVYHGY VPYWGQGTTVTVSSGGGGSGGGGSGGGGSGGGGSGGGGS DIQMTQSPSSLSASVGDRVTITCKASQDVYNAVAWYQQKPG QSPKLLIYSASSRYTGVPSRFTGSGSGPDFTFTISSVQAEDLA VYFCQQHFRTPFTFGSGTKLEIK |
| SEQ ID NO: 820 | cell-targeting molecule 48 | MKEFTLDFSTASTYVDSLNVIRSAIGTPLQTISSGGTSLLMIDS GIGDNLFAVDILGFDFTLGRFNNLRLIVERNNLYVTGFVNRT NNVFYRFADFSHVTFPGTTAVTLSADSSYTTLQRVAGISRTG MQINRHSLTTSYLDLMSHSGTSLTQSVARAMLRFVTVTAEA LRFRQIQRGFRTTLDDLSGASYVMTAEDVDLTLNWGRLSSV LPDYHGQDSVRVGRISFGSINAILGSVALILNSHHHASAVAA EFPKPSTPPGSSGGAPQVQLQQSGPELKKPGETVKISCKASG YPFTNYGMNWVKQAPGQGLKWMGWINTSTGESTFADDFK GRFDFSLETSANTAYLQINNLKSEDSATYFCARWEVYHGYV PYWGQGTTVTVSSGGGGSGGGGSGGGGSGGGGSGGGGSDI QMTQSPSSLSASVGDRVTITCKASQDVYNAVAWYQQKPGQ SPKLLIYSASSRYTGVPSRFTGSGSGPDFTFTISSVQAEDLAV YFCQQHFRTPFTFGSGTKLEIK |
| SEQ ID NO: 821 | cell-targeting molecule 49 | MREFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPQVQLQQSGPELKKPGETVKISCKAS GYPFTNYGMNWVKQAPGQGLKWMGWINTSTGESTFADDF KGRFDFSLETSANTAYLQINNLKSEDSATYFCARWEVYHGY VPYWGQGTTVTVSSGGGGSGGGGSGGGGSGGGGSGGGGS DIQMTQSPSSLSASVGDRVTITCKASQDVYNAVAWYQQKPG QSPKLLIYSASSRYTGVPSRFTGSGSGPDFTFTISSVQAEDLA VYFCQQHFRTPFTFGSGTKLEIK |
| SEQ ID NO: 822 | cell-targeting molecule 50 | MHEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPQVQLQQSGPELKKPGETVKISCKAS GYPFTNYGMNWVKQAPGQGLKWMGWINTSTGESTFADDF KGRFDFSLETSANTAYLQINNLKSEDSATYFCARWEVYHGY VPYWGQGTTVTVSSGGGGSGGGGSGGGGSGGGGSGGGGS DIQMTQSPSSLSASVGDRVTITCKASQDVYNAVAWYQQKPG QSPKLLIYSASSRYTGVPSRFTGSGSGPDFTFTISSVQAEDLA VYFCQQHFRTPFTFGSGTKLEIK |
| SEQ ID NO: 823 | cell-targeting molecule 51 | MSEFTLDFSTAKTYVDSLNVIRSAIGTPLQTISSGGTSLLMIDS GIGDNLFAVDILGFDFTLGRFNNLRLIVERNNLYVTGFVNRT NNVFYRFADFSHVTFPGTTAVTLSADSSYTTLQRVAGISRTG MQINRHSLTTSYLDLMSHSGTSLTQSVARAMLRFVTVTAEA LRFRQIQRGFRTTLDDLSGASYVMTAEDVDLTLNWGRLSSV LPDYHGQDSVRVGRISFGSINAILGSVALILNSHHHASAVAA EFPKPSTPPGSSGGAPQVQLQQSGPELKKPGETVKISCKASG YPFTNYGMNWVKQAPGQGLKWMGWINTSTGESTFADDFK GRFDFSLETSANTAYLQINNLKSEDSATYFCARWEVYHGYV PYWGQGTTVTVSSGGGGSGGGGSGGGGSGGGGSGGGGSDI QMTQSPSSLSASVGDRVTITCKASQDVYNAVAWYQQKPGQ SPKLLIYSASSRYTGVPSRFTGSGSGPDFTFTISSVQAEDLAV YFCQQHFRTPFTFGSGTKLEIK |

-continued

Sequence Listing

| ID Number | Text Description | Biological Sequence |
|---|---|---|
| SEQ ID NO: 824 | cell-targeting molecule 52 | MREFTLDFSTARTYVDSLNVIRSAIGTPLQTISSGGTSLLMIDS GIGDNLFAVDILGFDFTLGRFNNLRLIVERNNLYVTGFVNRT NNVFYRFADFSHVTFPGTTAVTLSADSSYTTLQRVAGISRTG MQINRHSLTTSYLDLMSHSGTSLTQSVARAMLRFVTVTAEA LRFRQIQRGFRTTLDDLSGASYVMTAEDVDLTLNWGRLSSV LPDYHGQDSVRVGRISFGSINAILGSVALILNSHHHASAVAA EFPKPSTPPGSSGGAPQVQLQQSGPELKKPGETVKISCKASG YPFTNYGMNWVKQAPGQGLKWMGWINTSTGESTFADDFK GRFDFSLETSANTAYLQINNLKSEDSATYFCARWEVYHGYV PYWGQGTTVTVSSGGGGSGGGGSGGGGSGGGGSGGGGSDI QMTQSPSSLSASVGDRVTITCKASQDVYNAVAWYQQKPGQ SPKLLIYSASSRYTGVPSRFTGSGSGPDFTFTISSVQAEDLAV YFCQQHFRTPFTFGSGTKLEIK |
| SEQ ID NO: 825 | cell-targeting molecule 53 | MHEFTLDFSTAHTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPQVQLQQSGPELKKPGETVKISCKAS GYPFTNYGMNWVKQAPGQGLKWMGWINTSTGESTFADDF KGRFDFSLETSANTAYLQINNLKSEDSATYFCARWEVYHGY VPYWGQGTTVTVSSGGGGSGGGGSGGGGSGGGGSGGGGS DIQMTQSPSSLSASVGDRVTITCKASQDVYNAVAWYQQKPG QSPKLLIYSASSRYTGVPSRFTGSGSGPDFTFTISSVQAEDLA VYFCQQHFRTPFTFGSGTKLEIK |
| SEQ ID NO: 826 | cell-targeting molecule 54 | MSEFTLDFSTASTYVDSLNVIRSAIGTPLQTISSGGTSLLMIDS GIGDNLFAVDILGFDFTLGRFNNLRLIVERNNLYVTGFVNRT NNVFYRFADFSHVTFPGTTAVTLSADSSYTTLQRVAGISRTG MQINRHSLTTSYLDLMSHSGTSLTQSVARAMLRFVTVTAEA LRFRQIQRGFRTTLDDLSGASYVMTAEDVDLTLNWGRLSSV LPDYHGQDSVRVGRISFGSINAILGSVALILNSHHHASAVAA EFPKPSTPPGSSGGAPQVQLQQSGPELKKPGETVKISCKASG YPFTNYGMNWVKQAPGQGLKWMGWINTSTGESTFADDFK GRFDFSLETSANTAYLQINNLKSEDSATYFCARWEVYHGYV PYWGQGTTVTVSSGGGGSGGGGSGGGGSGGGGSGGGGSDI QMTQSPSSLSASVGDRVTITCKASQDVYNAVAWYQQKPGQ SPKLLIYSASSRYTGVPSRFTGSGSGPDFTFTISSVQAEDLAV YFCQQHFRTPFTFGSGTKLEIK |
| SEQ ID NO: 827 | cell-targeting molecule 55 | MREFTLDFSTARTYVDSLNVIRSAIGTPLQTISSGGTSLLMIDS GIGDNLFAVDILGFDFTLGRFNNLRLIVERNNLYVTGFVNRT NNVFYRFADFSHVTFPGTTAVTLSADSSYTTLQRVAGISRTG MQINRHSLTTSYLALMSHSGTSLTQSVARAMLRFVTVTAEA LRFRQIQRGFRTTLDDLSGASYVMTAEDVDLTLNWGRLSSV LPDYHGQDSVRVGRISFGSINAILGSVALILNSHHHASAVAA SPSTPPTPSPSTPPASQVQLQQSGPELKKPGETVKISCKASGY PFTNYGMNWVKQAPGQGLKWMGWINTSTGESTFADDFKG RFDFSLETSANTAYLQINNLKSEDSATYFCARWEVYHGYVP YWGQGTTVTVSSGGGGSGGGGSGGGGSGGGGSGGGGSDIQ MTQSPSSLSASVGDRVTITCKASQDVYNAVAWYQQKPGQSP KLLIYSASSRYTGVPSRFTGSGSGPDFTFTISSVQAEDLAVYF CQQHFRTPFTFGSGTKLEIK |
| SEQ ID NO: 828 | cell-targeting molecule 56 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPQVQLQQSGPELKKPGETVKISCKAS GYPFTNYGMNWVKQAPGQGLKWMGWINTSTGESTFADDF KGRFDFSLETSANTAYLQINNLKSEDSATYFCARWEVYHGY VPYWGQGTTVTVSSGGGGSGGGGSGGGGSGGGGSGGGGS DIQMTQSPSSLSASVGDRVTITCKASQDVYNAVAWYQQKPG QSPKLLIYSASSRYTGVPSRFTGSGSGPDFTFTISSVQAEDLA VYFCQQHFRTPFTFGSGTKLEIK |
| SEQ ID NO: 829 | cell-targeting molecule 57 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE |

-continued

Sequence Listing

| ID Number | Text Description | Biological Sequence |
|---|---|---|
| | | ALRFRQIQRGFRTTLDDLSGASYVMTAEDVDLTLNWGRLSS VLPDYHGQDSVRVGRISFGSINAILGSVALILNSHHHASAVA ASPSTPPTPSPSTPPASQVQLQQSGPELKKPGETVKISCKASG YPFTNYGMNWVKQAPGQGLKWMGWINTSTGESTFADDFK GRFDFSLETSANTAYLQINNLKSEDSATYFCARWEVYHGYV PYWGQGTTVTVSSGGGGSGGGGSGGGGSGGGGSGGGGSDI QMTQSPSSLSASVGDRVTITCKASQDVYNAVAWYQQKPGQ SPKLLIYSASSRYTGVPSRFTGSGSGPDFTFTISSVQAEDLAV YFCQQHFRTPFTFGSGTKLEIK |
| SEQ ID NO: 830 | SLT-1A1-WT | KEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 831 | SLT-1A-D1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 832 | SLT-1A-D1-C242 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTAEAL RFRQIQRGFRTTLDDLSGASYVMTAEDVDLTLNWGRLSSVL PDYHGQDSVRVGRISFGSINAILGSVALILNCHHHASAVAA |
| SEQ ID NO: 833 | SLT-1A-D2 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSATSLTQSVARAMLRFVTVTAEAL RFRQIQRGFRTTLDDLSGASYVMTAEDVDLTLNWGRLSSVL PDYHGQDSVRVGRISFGSINAILGSVALILNSHHHASRVAR |
| SEQ ID NO: 834 | IA-SLT-1A-D1 | KEFTLDFSTAKTYVDSLNVIRSAIGTPLQTISSGGTSLLMIDSG IGDNLFAVDILGFDFTLGRFNNLRLIVERNNLYVTGFVNRTN NVFYRFADFSHVTFPGTTAVTLSADSSYTTLQRVAGISRTGM QINRHSLTTSYLDLMSHSGTSLTQSVARAMLRFVTVTADAL RFRQIQRGFRTTLDDLSGASYVMTAEDVDLTLNWGRLSSVL PDYHGQDSVRVGRISFGSINAILGSVALILNSHHHASAVAA |
| SEQ ID NO: 835 | cell-targeting protein 1 | MKEFTLDFSTAKTYVDSLNVIRSAIGTPLQTISSGGTSLLMID SGSGDNLFAVDVRGIDPEEGRFNNLRLIVERNNLYVTGFVNR TNNVFYRFADFSHVTFPGTTAVTLSGDSSYTTLQRVAGISRT GMQINRHSLTTSYLDLMSHSGTSLTQSVARAMLRFVTVTAE ALRFRQIQRGFRTTLDDLSGRSYVMTAEDVDLTLNWGRLSS VLPDYHGQDSVRVGRISFGSINAILGSVALILNCHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 836 | cell-targeting protein 2 | MEIVLTQSPATLSLSPGERATLSCRASQSVSSYLAWYQQKPG QAPRLLIYDASNRATGIPARFSGSGSGTDFTLTISSLEPEDFAV YYCQQRSDWPLTFGGGTKVEIKGSTSGSGKPGSGEGSAVQL VESGGGLVQPGRSLRLSCAASGFTFGDYTMHWVRQAPGKG LEWVSGISWNSGSIGYADSVKGRFTISRDNAKNSLYLQMNS LRAEDTALYYCTKDNQYGSGSTYGLGVWGQGTLVTVSSEF PKPSTPPGSSGGAPKEFTLDFSTAKTYVDSLNVIRSAIGTPLQ TISSGGTSLLMIDSGIGDNLFAVDILGFDFTLGRFNNLRLIVER NNLYVTGFVNRTNNVFYRFADFSHVTFPGTTAVTLSADSSY TTLQRVAGISRTGMQINRHSLTTSYLDLMSHSATSLTQSVAR AMLRFVTVTAEALRFRQIQRGFRTTLDDLSGASYVMTAEDV DLTLNWGRLSSVLPDYHGQDSVRVGRISFGSINAILGSVALIL NCHHHASRVAR |
| SEQ ID NO: 837 | cell-targeting protein 3 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT |

-continued

Sequence Listing

| ID Number | Text Description | Biological Sequence |
|---|---|---|
| | | GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNCHHHASAVA AEFPKPSTPPGSSGGAPDIVLTQSPASLAVSLGQRATISCRAT ESVEYYGTSLVQWYQQKPGQPPKLLIYAASSVDSGVPARFS GSGSGTDFSLTIHPVEEDDIAMYFCQQSRRVPYTFGGGTKLEI KGGGGSGGGGSGGGGSGGGGSGGGGSEVQLQQSGPELVKP GASVKMSCKASGYTFTSYVMHWVKQKPGQGLEWIGYVNP FNDGTKYNEMFKGKATLTSDKSSSTAYMELSSLTSEDSAVY YCARQAWGYPWGQGTLVTVSA |
| SEQ ID NO: 838 | reference cell-targeting molecule 1 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 839 | reference cell-targeting molecule 2 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIVLTQSPASLAVSLGQRATISCRAT ESVEYYGTSLVQWYQQKPGQPPKLLIYAASSVDSGVPARFS GSGSGTDFSLTIHPVEEDDIAMYFCQQSRRVPYTFGGGTKLEI KGGGGSGGGGSGGGGSGGGGSGGGGSEVQLQQSGPELVKP GASVKMSCKASGYTFTSYVMHWVKQKPGQGLEWIGYVNP FNDGTKYNEMFKGKATLTSDKSSSTAYMELSSLTSEDSAVY YCARQAWGYPWGQGTLVTVSA |
| SEQ ID NO: 840 | reference cell-targeting molecule 3 | MEIVLTQSPATLSLSPGERATLSCRASQSVSSYLAWYQQKPG QAPRLLIYDASNRATGIPARFSGSGSGTDFTLTISSLEPEDFAV YYCQQRSDWPLTFGGGTKVEIKGSTSGSGKPGSGEGSAVQL VESGGGLVQPGRSLRLSCAASGFTFGDYTMHWVRQAPGKG LEWVSGISWNSGSIGYADSVKGRFTISRDNAKNSLYLQMNS LRAEDTALYYCTKDNQYGSGSTYGLGVWGQGTLVTVSSEF PKPSTPPGSSGGAPKEFTLDFSTAKTYVDSLNVIRSAIGTPLQ TISSGGTSLLMIDSGSGDNLFAVDILGFDFTLGRFNNLRLIVE RNNLYVTGFVNRTNNVFYRFADFSHVTFPGTTAVTLSADSS YTTLQRVAGISRTGMQINRHSLTTSYLDLMSHSATSLTQSVA RAMLRFVTVTAEALRFRQIQRGFRTTLDDLSGASYVMTAED VDLTLNWGRLSSVLPDYHGQDSVRVGRISFGSINAILGSVALI LNSHHHASRVAR |
| SEQ ID NO: 841 | reference cell-targeting molecule 4 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AAHHSEDPSSKAPKAPEVQLVESGGGLVQAGGSLRLSCAAS GITFSINTMGWYRQAPGKQRELVALISSIGDTYYADSVKGRF TISRDNAKNTVYLQMNSLKPEDTAVYYCKRFRTAAQGTDY WGQGTQVTVSSA |
| SEQ ID NO: 842 | reference cell-targeting molecule 5 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAE ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS |

-continued

| Sequence Listing | | |
|---|---|---|
| ID Number | Text Description | Biological Sequence |
| | | LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 843 | reference cell-targeting molecule 1 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |
| SEQ ID NO: 844 | heavy chain ABR1 | YTFTSYVMH |
| SEQ ID NO: 845 | heavy chain ABR2 | WIGYINPYNDGTKY |
| SEQ ID NO: 846 | heavy chain ABR3 | RGTYYYGSRVFDY |
| SEQ ID NO: 847 | light chain ABR1 | KSLLNSNGNTYLY |
| SEQ ID NO: 848 | light chain ABR2 | LLIYRMSNLAS |
| SEQ ID NO: 849 | light chain ABR3 | MQHLEYPF |
| SEQ ID NO: 850 | heavy chain ABR1 | YAFSSYWMN |
| SEQ ID NO: 851 | heavy chain ABR2 | WIGQIWPGDGDTNY |
| SEQ ID NO: 852 | heavy chain ABR3 | RRETTTVGRYYYAMDY |
| SEQ ID NO: 853 | light chain ABR1 | QSVDYDGDSYLN |
| SEQ ID NO: 854 | light chain ABR2 | LLIYDASNLVS |
| SEQ ID NO: 855 | light chain ABR3 | QQSTEDPW |
| SEQ ID NO: 856 | heavy chain ABR2 | WIGQIWPGDGDTNYNG |
| SEQ ID NO: 857 | heavy chain ABR1 | GSISTSGMGVG |
| SEQ ID NO: 858 | heavy chain ABR2 | WIGHIWWDDDKRY |
| SEQ ID NO: 859 | heavy chain ABR3 | RMELWSYYFDY |
| SEQ ID NO: 860 | light chain ABR1 | SSVSYMH |
| SEQ ID NO: 861 | light chain ABR2 | LLIYDTSKLAS |
| SEQ ID NO: 862 | light chain ABR3 | FQGSVYPF |
| SEQ ID NO: 863 | heavy chain CDR1 | GYTFTSYNMH |
| SEQ ID NO: 864 | heavy chain CDR2 | AIYPGNGDTSYNQKFKG |
| SEQ ID NO: 865 | heavy chain CDR3 | AQLRPNYWYFDV |
| SEQ ID NO: 866 | light chain CDR1 | RASSSVSYMH |
| SEQ ID NO: 867 | light chain CDR2 | ATSNLAS |
| SEQ ID NO: 868 | light chain CDR3 | QQWISNPPT |
| SEQ ID NO: 869 | heavy chain CDR1 | GYTFTSYNVH |
| SEQ ID NO: 870 | heavy chain CDR3 | SNYYGSSYVWFFDV |
| SEQ ID NO: 871 | light chain CDR1 | RASSSVSYMD |
| SEQ ID NO: 872 | heavy chain CDR3 | STYYGGDWYFNV |

-continued

| Sequence Listing | | |
|---|---|---|
| ID Number | Text Description | Biological Sequence |
| SEQ ID NO: 873 | light chain CDR1 | RASSSVSYIH |
| SEQ ID NO: 874 | light chain CDR3 | QQWTSNPPT |
| SEQ ID NO: 875 | heavy chain CDR1 | GFTFNDYAMH |
| SEQ ID NO: 876 | heavy chain CDR2 | TISWNSGSIGYADSVKG |
| SEQ ID NO: 877 | heavy chain CDR3 | DIQYGNYYYGMDV |
| SEQ ID NO: 878 | light chain CDR1 | RASQSVSSYLA |
| SEQ ID NO: 879 | light chain CDR2 | DASNRAT |
| SEQ ID NO: 880 | light chain CDR3 | QQRSNWPIT |
| SEQ ID NO: 881 | heavy chain CDR1 | GYTFTSYNMH |
| SEQ ID NO: 882 | heavy chain CDR3 | VVYYSNSYWYFDV |
| SEQ ID NO: 883 | light chain CDR2 | APSNLAS |
| SEQ ID NO: 884 | light chain CDR3 | QQWSFNPPT |
| SEQ ID NO: 885 | heavy chain CDR1 | GYAFSYSWIN |
| SEQ ID NO: 886 | heavy chain CDR2 | RIFPGDGDTDYNGKFKG |
| SEQ ID NO: 887 | heavy chain CDR3 | NVFDGYWLVY |
| SEQ ID NO: 888 | light chain CDR1 | RSSKSLLHSNGITYLY |
| SEQ ID NO: 889 | light chain CDR2 | QMSNLVS |
| SEQ ID NO: 890 | light chain CDR3 | AQNLELPYT |
| SEQ ID NO: 891 | heavy chain ABR1 | YRFTNYWIH |
| SEQ ID NO: 892 | heavy chain ABR2 | WIGGINPGNNYATYRR |
| SEQ ID NO: 893 | heavy chain ABR3 | TREGYGNYGAWFAY |
| SEQ ID NO: 894 | light chain ABR1 | QSLANSYGNTFLS |
| SEQ ID NO: 895 | light chain ABR2 | LLIYGISNRFS |
| SEQ ID NO: 896 | light chain ABR3 | LQGTHQPY |
| SEQ ID NO: 897 | heavy chain ABR1 | FAFSIYDMS |
| SEQ ID NO: 898 | heavy chain ABR2 | WVAYISSGGGTTYY |
| SEQ ID NO: 899 | heavy chain ABR3 | RHSGYGTHWGVLFAY |
| SEQ ID NO: 900 | light chain ABR1 | QDISNYLA |
| SEQ ID NO: 901 | light chain ABR2 | LLIYYTSILHS |
| SEQ ID NO: 902 | light chain ABR3 | QQGNTLPW |
| SEQ ID NO: 903 | heavy chain ABR1 | YTFTSYWLH |
| SEQ ID NO: 904 | heavy chain ABR2 | WIGYINPRNDYTEY |
| SEQ ID NO: 905 | heavy chain ABR3 | RRDITTFY |
| SEQ ID NO: 906 | light chain ABR1 | QSVLYSANHKNYLA |
| SEQ ID NO: 907 | light chain ABR2 | LLIYWASTRES |
| SEQ ID NO: 908 | light chain ABR3 | HQYLSSW |
| SEQ ID NO: 909 | heavy chain ABR1 | YEFSRSWMN |
| SEQ ID NO: 910 | heavy chain ABR2 | WVGRIYPGDGDTNYSGKF |

-continued

Sequence Listing

| ID Number | Text Description | Biological Sequence |
|---|---|---|
| SEQ ID NO: 911 | heavy chain ABR3 | RDGSSWDWYFDV |
| SEQ ID NO: 912 | light chain ABR1 | QSIVHSVGNTFLE |
| SEQ ID NO: 913 | light chain ABR2 | LLIYKVSNRFS |
| SEQ ID NO: 914 | light chain ABR3 | FQGSQFPY |
| SEQ ID NO: 915 | heavy chain CDR1 | GYRFTNYWIH |
| SEQ ID NO: 916 | heavy chain CDR2 | GINPGNNYATYRRKFQG |
| SEQ ID NO: 917 | heavy chain CDR3 | EGYGNYGAWFAY |
| SEQ ID NO: 918 | light chain CDR1 | RSSQSLANSYGNTFLS |
| SEQ ID NO: 919 | light chain CDR2 | GISNRFS |
| SEQ ID NO: 920 | light chain CDR3 | LQGTHQPYT |
| SEQ ID NO: 921 | heavy chain CDR1 | GFAFSIYDMS |
| SEQ ID NO: 922 | heavy chain CDR2 | YISSGGGTYYPDTVKG |
| SEQ ID NO: 923 | heavy chain CDR3 | HSGYGTHWGVLFAY |
| SEQ ID NO: 924 | light chain CDR1 | RASQDISNYLA |
| SEQ ID NO: 925 | light chain CDR2 | YTSILHS |
| SEQ ID NO: 926 | light chain CDR3 | QQGNTLPWT |
| SEQ ID NO: 927 | heavy chain CDR1 | GYTFTDYYIT |
| SEQ ID NO: 928 | heavy chain CDR2 | WIYPGSGNTKYNEKF |
| SEQ ID NO: 929 | heavy chain CDR3 | YGNYWFAY |
| SEQ ID NO: 930 | light chain CDR1 | KASQSVDFDGDSYMN |
| SEQ ID NO: 931 | light chain CDR2 | AASNLES |
| SEQ ID NO: 932 | light chain CDR3 | QQSNEDPWT |
| SEQ ID NO: 933 | heavy chain CDR1 | YTFTTYWMH |
| SEQ ID NO: 934 | heavy chain CDR2 | WIGYINPSTGYTDY |
| SEQ ID NO: 935 | heavy chain CDR3 | TRRGPSYGNHGAWFPY |
| SEQ ID NO: 936 | light chain CDR1 | ENVDTYVS |
| SEQ ID NO: 937 | light chain CDR2 | LLIYGASNRYT |
| SEQ ID NO: 938 | light chain CDR3 | GQSYRYPP |
| SEQ ID NO: 939 | heavy chain CDR1 | GYTFTGYYMH |
| SEQ ID NO: 940 | heavy chain CDR2 | WIDPNSGATTYAQKF |
| SEQ ID NO: 941 | heavy chain CDR3 | KTTQTTWGFPF |
| SEQ ID NO: 942 | light chain CDR1 | RASQGVYQWLA |
| SEQ ID NO: 943 | light chain CDR2 | KASHLYN |
| SEQ ID NO: 944 | light chain CDR3 | QQLNSYPLT |
| SEQ ID NO: 945 | heavy chain CDR1 | GYTFTDYWMH |
| SEQ ID NO: 946 | heavy chain CDR2 | WIGYINPNTAYTDY |
| SEQ ID NO: 947 | light chain CDR1 | KASENVDSFVS |

-continued

Sequence Listing

| ID Number | Text Description | Biological Sequence |
|---|---|---|
| SEQ ID NO: 948 | light chain CDR2 | GASNRYT |
| SEQ ID NO: 949 | light chain CDR3 | GQNYRYPLT |
| SEQ ID NO: 950 | heavy chain ABR1 | FSLISYGVH |
| SEQ ID NO: 951 | heavy chain ABR2 | WLGVIWRGGSTDY |
| SEQ ID NO: 952 | heavy chain ABR3 | KTLITTGYAMDY |
| SEQ ID NO: 953 | light chain ABR1 | EDIYNRLA |
| SEQ ID NO: 954 | light chain ABR2 | LLISGATSLETG |
| SEQ ID NO: 955 | light chain ABR3 | QQYWSTP |
| SEQ ID NO: 956 | heavy chain ABR1 | FTFNSFAMS |
| SEQ ID NO: 957 | heavy chain ABR2 | WVSAISGSGGGTYY |
| SEQ ID NO: 958 | heavy chain ABR3 | KDKILWFGEPVFDY |
| SEQ ID NO: 959 | light chain ABR1 | QSVSSYLA |
| SEQ ID NO: 960 | light chain ABR2 | LLIYDASNRAT |
| SEQ ID NO: 961 | light chain ABR3 | QQRSNWPP |
| SEQ ID NO: 962 | heavy chain ABR1 | FSLTSYGVH |
| SEQ ID NO: 963 | heavy chain ABR2 | WIGVMWRGGSTDY |
| SEQ ID NO: 964 | heavy chain ABR3 | KSMITTGFVMDS |
| SEQ ID NO: 965 | light chain ABR1 | EDIYNRLT |
| SEQ ID NO: 966 | light chain ABR2 | LLISGATSLET |
| SEQ ID NO: 967 | light chain ABR3 | QQYWSNPY |
| SEQ ID NO: 968 | heavy chain ABR1 | FDFSRSWMN |
| SEQ ID NO: 969 | heavy chain ABR2 | WIGEINPDSSTINY |
| SEQ ID NO: 970 | heavy chain ABR3 | RYGNWFPY |
| SEQ ID NO: 971 | light chain ABR1 | QNVDTNVA |
| SEQ ID NO: 972 | light chain ABR2 | ALIYSASYRYS |
| SEQ ID NO: 973 | light chain ABR3 | QQYDSYPL |
| SEQ ID NO: 974 | heavy chain ABR1 | GTFSSYAFS |
| SEQ ID NO: 975 | heavy chain ABR2 | WMGRVIPFLGIANS |
| SEQ ID NO: 976 | heavy chain ABR3 | RDDIAALGPFDY |
| SEQ ID NO: 977 | light chain ABR1 | QGISSWLA |
| SEQ ID NO: 978 | light chain ABR2 | SLIYAASSLQS |
| SEQ ID NO: 979 | light chain ABR3 | QQYNSYPR |
| SEQ ID NO: 980 | heavy chain ABR1 | YTFTDYWMQ |
| SEQ ID NO: 981 | heavy chain ABR2 | WIGTIYPGDGDTGY |
| SEQ ID NO: 982 | heavy chain ABR3 | RGDYYGSNSLDY |
| SEQ ID NO: 983 | light chain ABR1 | QDVSTVVA |
| SEQ ID NO: 984 | light chain ABR2 | RLIYSASYRYI |
| SEQ ID NO: 985 | light chain ABR3 | QQHYSPPY |

-continued

Sequence Listing

| ID Number | Text Description | Biological Sequence |
|---|---|---|
| SEQ ID NO: 986 | heavy chain CDR1 | GFSLTSYGVH |
| SEQ ID NO: 987 | heavy chain CDR2 | VMWRGGSTDYNAAFMS |
| SEQ ID NO: 988 | heavy chain CDR3 | SMITTGFVMDS |
| SEQ ID NO: 989 | light chain CDR1 | KASEDIYNRLT |
| SEQ ID NO: 990 | light chain CDR2 | GATSLET |
| SEQ ID NO: 991 | light chain CDR3 | QQYWSNPYT |
| SEQ ID NO: 992 | heavy chain CDR1 | GFSLISYGVH |
| SEQ ID NO: 993 | heavy chain CDR2 | VIWRGGSTDYNAAFMS |
| SEQ ID NO: 994 | heavy chain CDR3 | TLITTGYAMDY |
| SEQ ID NO: 995 | light chain CDR1 | KASEDIYNRLA |
| SEQ ID NO: 996 | light chain CDR2 | GATSLET |
| SEQ ID NO: 997 | light chain CDR3 | QQYWSTPT |
| SEQ ID NO: 998 | heavy chain CDR1 | GFDFSRSWMN |
| SEQ ID NO: 999 | heavy chain CDR2 | EINPDSSTINYTTSLKD |
| SEQ ID NO: 1000 | heavy chain CDR3 | YGNWFPY |
| SEQ ID NO: 1001 | light chain CDR1 | KASQNVDTNVA |
| SEQ ID NO: 1002 | light chain CDR2 | SASYRYS |
| SEQ ID NO: 1003 | light chain CDR3 | QQYDSYPLT |
| SEQ ID NO: 1004 | heavy chain ABR1 | FDFSRYWMS |
| SEQ ID NO: 1005 | heavy chain ABR2 | WIGEINPTSSTINF |
| SEQ ID NO: 1006 | heavy chain ABR3 | RGNYYRYGDAMDY |
| SEQ ID NO: 1007 | light chain ABR1 | KSVSTSGYSYLH |
| SEQ ID NO: 1008 | light chain ABR2 | LLIYLASNLES |
| SEQ ID NO: 1009 | light chain ABR3 | QHSRELPF |
| SEQ ID NO: 1010 | heavy chain ABR1 | STFTTYWIH |
| SEQ ID NO: 1011 | heavy chain ABR2 | WIGYINPNTGYTEY |
| SEQ ID NO: 1012 | heavy chain ABR3 | VRFITVVGG |
| SEQ ID NO: 1013 | light chain ABR1 | SSVSSSHLH |
| SEQ ID NO: 1014 | light chain ABR2 | LWIYSTSNLAS |
| SEQ ID NO: 1015 | light chain ABR3 | HQYHRSPL |
| SEQ ID NO: 1016 | heavy chain ABR1 | FSLTTYGIGVG |
| SEQ ID NO: 1017 | heavy chain ABR2 | WLTHIWWNDNKYY |
| SEQ ID NO: 1018 | heavy chain ABR3 | YGYTY |
| SEQ ID NO: 1019 | light chain ABR1 | QSLLYSNGNTYLH |
| SEQ ID NO: 1020 | light chain ABR2 | LLIYKLSNRFS |
| SEQ ID NO: 1021 | light chain ABR3 | SQSTHVPW |
| SEQ ID NO: 1022 | heavy chain ABR1 | FNIKDTYIH |

-continued

| Sequence Listing | | |
|---|---|---|
| ID Number | Text Description | Biological Sequence |
| SEQ ID NO: 1023 | heavy chain ABR2 | WVARIYPTNGYTRY |
| SEQ ID NO: 1024 | heavy chain ABR3 | RWGGDGFYAMDY |
| SEQ ID NO: 1025 | light chain ABR1 | QDVNTAVA |
| SEQ ID NO: 1026 | light chain ABR2 | LLIYSASFLYS |
| SEQ ID NO: 1027 | light chain ABR3 | QQHYTTPP |
| SEQ ID NO: 1028 | heavy chain ABR3 | RWGGDGFYAMDV |
| SEQ ID NO: 1029 | heavy chain ABR1 | YSFTSYWIA |
| SEQ ID NO: 1030 | heavy chain ABR2 | YMGLIYPGDSDTKY |
| SEQ ID NO: 1031 | heavy chain ABR3 | RHDVGYCSSSNCAKWPEYFQH |
| SEQ ID NO: 1032 | light chain ABR1 | SSNIGNNYVS |
| SEQ ID NO: 1033 | light chain ABR2 | LLIYGHTNRPA |
| SEQ ID NO: 1034 | light chain ABR3 | AAWDDSLSGW |
| SEQ ID NO: 1035 | heavy chain ABR1 | YPFTNYGMN |
| SEQ ID NO: 1036 | heavy chain ABR2 | WMGWINTSTGESTF |
| SEQ ID NO: 1037 | heavy chain ABR3 | RWEVYHGYVPY |
| SEQ ID NO: 1038 | light chain ABRI | QDVYNAVA |
| SEQ ID NO: 1039 | light chain ABR2 | LLIYSASSRYT |
| SEQ ID NO: 1040 | light chain ABR3 | QQHFRTPF |
| SEQ ID NO: 1041 | heavy chain ABRI | ITFS1NTMG |
| SEQ ID NO: 1042 | heavy chain ABR2 | LVALISSIGDTYYA |
| SEQ ID NO: 1043 | heavy chain ABR3 | KRFRTAAQGTDY |
| SEQ ID NO: 1044 | heavy chain CDRI | GFNIKDTYIH |
| SEQ ID NO: 1045 | heavy chain CDR2 | RIYPTNGYTRYADSVKG |
| SEQ ID NO: 1046 | heavy chain CDR3 | WGGDGFYAMDY |
| SEQ ID NO: 1047 | light chain CDRI | RASQDVNTAVA |
| SEQ ID NO: 1048 | light chain CDR2 | SASFLYS |
| SEQ ID NO: 1049 | light chain CDR3 | QQHYTTPPT |
| SEQ ID NO: 1050 | heavy chain CDR1 | GFNIKDTYIH |
| SEQ ID NO: 1051 | heavy chain CDR2 | RIYPTNGYTRYADSVKG |
| SEQ ID NO: 1052 | heavy chain CDR3 | WGGDGFYAMDV |
| SEQ ID NO: 1053 | light chain CDR1 | RASQDVNTAVA |
| SEQ ID NO: 1054 | light chain CDR2 | SASFLYS |
| SEQ ID NO: 1055 | light chain CDR3 | QQHYTTPPT |
| SEQ ID NO: 1056 | heavy chain CDR1 | GYSFTSYWIA |
| SEQ ID NO: 1057 | heavy chain CDR2 | LIYPGDSDTKYSPSFQG |
| SEQ ID NO: 1058 | heavy chain CDR3 | HDVGYCSSSNCAKWPEYFQH |
| SEQ ID NO: 1059 | light chain CDR1 | SGSSSNIGNNYVS |
| SEQ ID NO: 1060 | light chain CDR2 | GHTNRPA |

-continued

| Sequence Listing | | |
|---|---|---|
| ID Number | Text Description | Biological Sequence |
| SEQ ID NO: 1061 | light chain CDR3 | AAWDDSLSGWV |
| SEQ ID NO: 1062 | heavy chain CDR1 | GITFSINTMG |
| SEQ ID NO: 1063 | heavy chain CDR2 | LISSIGDTYYADSVKG |
| SEQ ID NO: 1064 | heavy chain CDR3 | FRTAAQGTDY |
| SEQ ID NO: 1065 | heavy chain ABR1 | FTFSDSWIH |
| SEQ ID NO: 1066 | heavy chain ABR2 | WVAWISPYGGSTYY |
| SEQ ID NO: 1067 | heavy chain ABR3 | RRHWPGGFDY |
| SEQ ID NO: 1068 | light chain ABR1 | QDVSTAVA |
| SEQ ID NO: 1069 | light chain ABR2 | LLIYSASFLYS |
| SEQ ID NO: 1070 | light chain ABR3 | QQYLYHPA |
| SEQ ID NO: 1071 | heavy chain ABR1 | YTFTSYVMH |
| SEQ ID NO: 1072 | heavy chain ABR2 | WIGYVNPFNDGTKY |
| SEQ ID NO: 1073 | heavy chain ABR3 | RQAWGYP |
| SEQ ID NO: 1074 | light chain ABR1 | ESVEYYGTSLVQ |
| SEQ ID NO: 1075 | light chain ABR2 | LLIYAASSVDS |
| SEQ ID NO: 1076 | light chain ABR3 | QQSRRVPY |
| SEQ ID NO: 1077 | heavy chain ABR1 | YTFTSYDVH |
| SEQ ID NO: 1078 | heavy chain ABR2 | WMGWLHADTGITKF |
| SEQ ID NO: 1079 | heavy chain ABR3 | RERIQLWFDY |
| SEQ ID NO: 1080 | light chain ABR1 | QGISSWLA |
| SEQ ID NO: 1081 | light chain ABR2 | SLIYAASSLQS |
| SEQ ID NO: 1082 | light chain ABR3 | QQYNSYPY |
| SEQ ID NO: 1083 | heavy chain ABR1 | DTFSTYAIS |
| SEQ ID NO: 1084 | heavy chain ABR2 | WMGGIIPIFGKAHY |
| SEQ ID NO: 1085 | heavy chain ABR3 | RKFHFVSGSPFGMDV |
| SEQ ID NO: 1086 | light chain ABR1 | QSVSSYLA |
| SEQ ID NO: 1087 | light chain ABR2 | LLIYDASNRAT |
| SEQ ID NO: 1088 | light chain ABR3 | QQRSNWP |
| SEQ ID NO: 1089 | heavy chain ABR1 | FTFSSYIMM |
| SEQ ID NO: 1090 | heavy chain ABR2 | WVSSIYPSGGITFY |
| SEQ ID NO: 1091 | heavy chain ABR3 | RIKLGTVTTVDY |
| SEQ ID NO: 1092 | light chain ABR1 | SSDVGGYNYVS |
| SEQ ID NO: 1093 | light chain ABR2 | LM1YDVSNRPS |
| SEQ ID NO: 1094 | light chain ABR3 | SSYTSSSTR |
| SEQ ID NO: 1095 | heavy chain CDR1 | GFNIKDYFLH |
| SEQ ID NO: 1096 | heavy chain CDR2 | WINPDNGNTVYDPKFQG |
| SEQ ID NO: 1097 | heavy chain CDR3 | RDYTYEKAALDY |

-continued

Sequence Listing

| ID Number | Text Description | Biological Sequence |
|---|---|---|
| SEQ ID NO: 1098 | light chain CDR1 | RASGNIYNYLA |
| SEQ ID NO: 1099 | light chain CDR2 | DAKTLAD |
| SEQ ID NO: 1100 | light chain CDR3 | QHFWSLPFT |
| SEQ ID NO: 1101 | SLT-1A-Cys5-D1 (inactivated) variant 2 | KEFTLDFSTAKTYVDSLNVIRSAIGTPLQTISCGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTADAL<br>RFRQIQRGFRTTLDDLSGASYVMTAEDVDLTLNWGRLSSVL<br>PDYHGQDSVRVGRISFGSINAILGSVALILNSHHHASAVAA |
| SEQ ID NO: 1102 | SLT-1A-Cys7-D1 (inactivated) variant 2 | KEFTLDFSTAKTYVDSLNVIRSAIGTPLQTISSGGTSLLMIDSG<br>CGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTADAL<br>RFRQIQRGFRTTLDDLSGASYVMTAEDVDLTLNWGRLSSVL<br>PDYHGQDSVRVGRISFGSINAILGSVALILNSHHHASAVAA |
| SEQ ID NO: 1103 | SLT-1A-Cys8-D1 (inactivated) variant 2 | KEFTLDFSTAKTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHCGTSLTQSVARAMLRFVTVTADAL<br>RFRQIQRGFRTTLDDLSGASYVMTAEDVDLTLNWGRLSSVL<br>PDYHGQDSVRVGRISFGSINAILGSVALILNSHHHASAVAA |
| SEQ ID NO: 1104 | SLT-1A-Cys9-D1 (inactivated) variant 2 | KEFTLDFSTAKTYVDSLNVIRSAIGTPLQTISSGGTSLLMIDSG<br>IGDNLFAVDILGFDFTLGRFNNLRLIVERNNLYVTGFVNRTN<br>NVFYRFADFSHVTFPGTTAVTLSADSSYTTLQRVAGISRTGM<br>QINRHSLTTSYLDLMSHSGTSLTQSVARAMLRFVTVTADAL<br>RFRQIQRGFRTTLDDLCGASYVMTAEDVDLTLNWGRLSSVL<br>PDYHGQDSVRVGRISFGSINAILGSVALILNSHHHASAVAA |
| SEQ ID NO: 1105 | cell-targeting protein 4 | MKEFTLDFSTAKTYVDSLNVIRSAIGTPLQTISSGGTSLLMID<br>SGIGDNLFAVDILGFDFTLGRFNNLRLIVERNNLYVTGFVNR<br>TNNVFYRFADFSHVTFPGTTAVTLSADSSYTTLQRVAGISRT<br>GMQINRHSLTTSYLDLMSHSGTSLTQSVARAMLRFVTVTAE<br>ALRFRQIQRGFRTTLDDLSGASYVMTAEDVDLTLNWGRLSS<br>VLPDYHGQDSVRVGRISFGSINAILGSVALILNSHHHASAVA<br>AEFPKPSTPPGSSGGAPDIQMTQSPSSLSASVGDRVTITCKAS<br>EDIYNRLTWYQQKPGKAPKLLISGATSLETGVPSRFSGSGSG<br>TDFTFTISSLQPEDIATYYCQQYWSNPYTFGQGTKVEIKGGG<br>GSQVQLQESGPGLVRPSQTLSLTCTVSGFSLTSYGVHWVRQ<br>PPGRGLEWIGVMWRGGSTDYNAAFMSRLNITKDNSKNQVS<br>LRLSSVTAADTAVYYCAKSMITTGFVMDSWGQGSLVTVSS |
| SEQ ID NO: 1106 | cell-targeting protein 5 | MKEFTLDFSTAKTYVDSLNVIRSAIGTPLQTISSGGTSLLMID<br>SGIGDNLFAVDILGFDFTLGRFNNLRLIVERNNLYVTGFVNR<br>TNNVFYRFADFSHVTFPGTTAVTLSADSSYTTLQRVAGISRT<br>GMQINRHSLTTSYLDLMSHSGTSLTQSVARAMLRFVTVTAD<br>ALRFRQIQRGFRTTLDDLSGASYVMTAEDVDLTLNWGRLSS<br>VLPDYHGQDSVRVGRISFGSINAILGSVALILNSHHHASAVA<br>AEFPKPSTPPGSSGGAPDIQMTQSPSSLSASVGDRVTITCKAS<br>EDIYNRLTWYQQKPGKAPKLLISGATSLETGVPSRFSGSGSG<br>TDFTFTISSLQPEDIATYYCQQYWSNPYTFGQGTKVEIKGGG<br>GSQVQLQESGPGLVRPSQTLSLTCTVSGFSLTSYGVHWVRQ<br>PPGRGLEWIGVMWRGGSTDYNAAFMSRLNITKDNSKNQVS<br>LRLSSVTAADTAVYYCAKSMITTGFVMDSWGQGSLVTVSS |
| SEQ ID NO: 1107 | cell-targeting protein 6 | MKEFTLDFSTAKTYVDSLNVIRSAIGTPLQTISSGGTSLLMID<br>SGIGDNLFAVDILGFDFTLGRFNNLRLIVERNNLYVTGFVNR<br>TNNVFYRFADFSHVTFPGTTAVTLSADSSYTTLQRVAGISRT<br>GMQINRHSLTTSYLDLMSHSGTSLTQSVARAMLRFVTVTAE<br>ALRFRQIQRGFRTTLDDLSGASYVMTAEDVDLTLNWGRLSS<br>VLPDYHGQDSVRVGRISFGSINAILGSVALILNSHHHASAVA<br>AEFPKPSTPPGSSGGAPDIQMTQSPSSLSASVGDRVTITCKAS<br>EDIYNRLTWYQQKPGKAPKLLISGATSLETGVPSRFSGSGSG<br>TDFTFTISSLQPEDIATYYCQQYWSNPYTFGQGTKVEIKGGG<br>GSGGGGSGGGGSGGGGSGGGGSQVQLQESGPGLVRPSQTLS<br>LTCTVSGFSLTSYGVHWVRQPPGRGLEWIGVMWRGGSTDY<br>NAAFMSRLNITKDNSKNQVSLRLSSVTAADTAVYYCAKSMI<br>TTGFVMDSWGQGSLVTVSS |

-continued

Sequence Listing

| ID Number | Text Description | Biological Sequence |
|---|---|---|
| SEQ ID NO: 1108 | cell-targeting protein 7 | MKEFTLDFSTAKTYVDSLNVIRSAIGTPLQTISSGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSGGGGSGGGGSGGGGSGGGGSQVQLQESGPGLVRPSQTLS LTCTVSGFSLTSYGVHWVRQPPGRGLEWIGVMWRGGSTDY NAAFMSRLNITKDNSKNQVSLRLSSVTAADTAVYYCAKSMI TTGFVMDSWGQGSLVTVSS |
| SEQ ID NO: 1109 | StxA-Lys (1) | KEFTLDFSTAATYVDSLNVIRSAIGTPLQTISSGGTSLLMIDSG TGDNLFAVDVRGIDPEEGRFNNLRLIVERNNLYVTGFVNRT NNVFYRFADFSHVTFPGTTAVTLSGDSSYTTLQRVAGISRTG MQINRHSLTTSYLDLMSHSGTSLTQSVARAMLRFVTVTAEA LRFRQIQRGFRTTLDDLSGRSYVMTAEDVDLTLNWGRLSSV LPDYHGQDSVRVGRISFGSINAILGSVALILNCHHHASRVAR MASDEFPSMCPADGRVRGITHNAILWDSSTLGAILMRRTISS |
| SEQ ID NO: 1110 | StxA-Lys (11) | AEFTLDFSTAKTYVDSLNVIRSAIGTPLQTISSGGTSLLMIDSG TGDNLFAVDVRGIDPEEGRFNNLRLIVERNNLYVTGFVNRT NNVFYRFADFSHVTFPGTTAVTLSGDSSYTTLQRVAGISRTG MQINRHSLTTSYLDLMSHSGTSLTQSVARAMLRFVTVTAEA LRFRQIQRGFRTTLDDLSGRSYVMTAEDVDLTLNWGRLSSV LPDYHGQDSVRVGRISFGSINAILGSVALILNCHHHASRVAR MASDEFPSMCPADGRVRGITHNAILWDSSTLGAILMRRTISS |
| SEQ ID NO: 1111 | StxA-Lys (274) | AEFTLDFSTAATYVDSLNVIRSAIGTPLQTISSGGTSLLMIDSG TGDNLFAVDVRGIDPEEGRFNNLRLIVERNNLYVTGFVNRT NNVFYRFADFSHVTFPGTTAVTLSGDSSYTTLQRVAGISRTG MQINRHSLTTSYLDLMSHSGTSLTQSVARAMLRFVTVTAEA LRFRQIQRGFRTTLDDLSGRSYVMTAEDVDLTLNWGRLSSV LPDYHGQDSVRVGRISFGSINAILGSVALILNCHHHASRVAR MASDEFPSMCPADGRVRGITHNKILWDSSTLGAILMRRTISS |
| SEQ ID NO: 1112 | StxA1-Lys (1) | KEFTLDFSTAATYVDSLNVIRSAIGTPLQTISSGGTSLLMIDSG TGDNLFAVDVRGIDPEEGRFNNLRLIVERNNLYVTGFVNRT NNVFYRFADFSHVTFPGTTAVTLSGDSSYTTLQRVAGISRTG MQINRHSLTTSYLDLMSHSGTSLTQSVARAMLRFVTVTAEA LRFRQIQRGFRTTLDDLSGRSYVMTAEDVDLTLNWGRLSSV LPDYHGQDSVRVGRISFGSINAILGSVALILNCHHHASRVAR |
| SEQ ID NO: 1113 | StxA-Lys (11) with amino-terminal truncation | KTYVDSLNVIRSAIGTPLQTISSGGTSLLMIDSGTGDNLFAVD VRGIDPEEGRFNNLRLIVERNNLYVTGFVNRTNNVFYRFADF SHVTFPGTTAVTLSGDSSYTTLQRVAGISRTGMQINRHSLTT SYLDLMSHSGTSLTQSVARAMLRFVTVTAEALRFRQIQRGF RTTLDDLSGRSYVMTAEDVDLTLNWGRLSSVLPDYHGQDS VRVGRISFGSINAILGSVALILNCHHHASRVARMASDEFPSM CPADGRVRGITHNAILWDSSTLGAILMRRTISS |
| SEQ ID NO: 1114 | StxA1-Lys (11) with amino-terminal truncation | KTYVDSLNVIRSAIGTPLQTISSGGTSLLMIDSGTGDNLFAVD VRGIDPEEGRFNNLRLIVERNNLYVTGFVNRTNNVFYRFADF SHVTFPGTTAVTLSGDSSYTTLQRVAGISRTGMQINRHSLTT SYLDLMSHSGTSLTQSVARAMLRFVTVTAEALRFRQIQRGF RTTLDDLSGRSYVMTAEDVDLTLNWGRLSSVLPDYHGQDS VRVGRISFGSINAILGSVALILNCHHHASRVAR |
| SEQ ID NO: 1115 | StxA-Lys (274) with amino-terminal truncation variant 1 | EFTLDFSTAATYVDSLNVIRSAIGTPLQTISSGGTSLLMIDSGT GDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVARM ASDEFPSMCPADGRVRGITHNKILWDSSTLGAILMRRTISS |

-continued

Sequence Listing

| ID Number | Text Description | Biological Sequence |
|---|---|---|
| SEQ ID NO: 1116 | StxA-Lys (274) with amino-terminal truncation variant 2 | TYVDSLNVIRSAIGTPLQTISSGGTSLLMIDSGTGDNLFAVDV RGIDPEEGRFNNLRLIVERNNLYVTGFVNRTNNVFYRFADFS HVTFPGTTAVTLSGDSSYTTLQRVAGISRTGMQINRHSLTTS YLDLMSHSGTSLTQSVARAMLRFVTVTAEALRFRQIQRGFR TTLDDLSGRSYVMTAEDVDLTLNWGRLSSVLPDYHGQDSV RVGRISFGSINAILGSVALILNCHHHASRVARMASDEFPSMCP ADGRVRGITHNKILWDSSTLGAILMRRTISS |
| SEQ ID NO: 1117 | SLT-1A-Lys (1) | KEFTLDFSTAATYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVARM ASDEFPSMCPADGRVRGITHNAILWDSSTLGAILMRRTISS |
| SEQ ID NO: 1118 | SLT-1A-Lys (11) | AEFTLDFSTAKTYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVARM ASDEFPSMCPADGRVRGITHNAILWDSSTLGAILMRRTISS |
| SEQ ID NO: 1119 | SLT-1A-Lys (274) | AEFTLDFSTAATYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVARM ASDEFPSMCPADGRVRGITHNKILWDSSTLGAILMRRTISS |
| SEQ ID NO: 1120 | SLT-1A1-Lys (1) | KEFTLDFSTAATYVDSLNVIRSAIGTPLQTISSGGTSLLMIDSG SGDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVAR |
| SEQ ID NO: 1121 | SLT-1A-Lys (11) with amino-terminal truncation variant 1 | KTYVDSLNVIRSAIGTPLQTISSGGTSLLMIDSGSGDNLFAVD VRGIDPEEGRFNNLRLIVERNNLYVTGFVNRTNNVFYRFADF SHVTFPGTTAVTLSGDSSYTTLQRVAGISRTGMQINRHSLTT SYLDLMSHSGTSLTQSVARAMLRFVTVTAEALRFRQIQRGF RTTLDDLSGRSYVMTAEDVDLTLNWGRLSSVLPDYHGQDS VRVGRISFGSINAILGSVALILNCHHHASRVARMASDEFPSM CPADGRVRGITHNAILWDSSTLGAILMRRTISS |
| SEQ ID NO: 1122 | SLT-1A1-Lys (11) with amino-terminal truncation variant 2 | KTYVDSLNVIRSAIGTPLQTISSGGTSLLMIDSGSGDNLFAVD VRGIDPEEGRFNNLRLIVERNNLYVTGFVNRTNNVFYRFADF SHVTFPGTTAVTLSGDSSYTTLQRVAGISRTGMQINRHSLTT SYLDLMSHSGTSLTQSVARAMLRFVTVTAEALRFRQIQRGF RTTLDDLSGRSYVMTAEDVDLTLNWGRLSSVLPDYHGQDS VRVGRISFGSINAILGSVALILNCHHHASRVAR |
| SEQ ID NO: 1123 | SLT-1A-Lys (274) with amino-terminal truncation variant 1 | EFTLDFSTAATYVDSLNVIRSAIGTPLQTISSGGTSLLMIDSGS GDNLFAVDVRGIDPEEGRFNNLRLIVERNNLYVTGFVNRTN NVFYRFADFSHVTFPGTTAVTLSGDSSYTTLQRVAGISRTGM QINRHSLTTSYLDLMSHSGTSLTQSVARAMLRFVTVTAEAL RFRQIQRGFRTTLDDLSGRSYVMTAEDVDLTLNWGRLSSVL PDYHGQDSVRVGRISFGSINAILGSVALILNCHHHASRVARM ASDEFPSMCPADGRVRGITHNKILWDSSTLGAILMRRTISS |
| SEQ ID NO: 1124 | SLT-1A-Lys (274) with amino-terminal truncation variant 2 | TYVDSLNVIRSAIGTPLQTISSGGTSLLMIDSGSGDNLFAVDV RGIDPEEGRFNNLRLIVERNNLYVTGFVNRTNNVFYRFADFS HVTFPGTTAVTLSGDSSYTTLQRVAGISRTGMQINRHSLTTS YLDLMSHSGTSLTQSVARAMLRFVTVTAEALRFRQIQRGFR TTLDDLSGRSYVMTAEDVDLTLNWGRLSSVLPDYHGQDSV RVGRISFGSINAILGSVALILNCHHHASRVARMASDEFPSMCP ADGRVRGITHNKILWDSSTLGAILMRRTISS |
| SEQ ID NO: 1125 | SLT-2A-Lys (11) | DEFTVDFSSQKSYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE |

-continued

Sequence Listing

| ID Number | Text Description | Biological Sequence |
|---|---|---|
| | | YRGEEGVRIGRISFNSLSAILGSVAVILNCHSTGSYSVRSVSQ AQATECQIVGDRAAIAVNNVLWEANTIAALLNRAPQDLTEP NQ |
| SEQ ID NO: 1126 | SLT-2A-Lys (255) | DEFTVDFSSQASYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVRSVSQ KQATECQIVGDRAAIAVNNVLWEANTIAALLNRAPQDLTEP NQ |
| SEQ ID NO: 1127 | SLT-2A-Lys (257) | DEFTVDFSSQASYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVRSVSQ AQKTECQIVGDRAAIAVNNVLWEANTIAALLNRAPQDLTEP NQ |
| SEQ ID NO: 1128 | SLT-2A-Lys (270) | DEFTVDFSSQASYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVRSVSQ AQATECQIVGDRAAIKVNNVLWEANTIAALLNRAPQDLTEP NQ |
| SEQ ID NO: 1129 | SLT-2A-Lys (288) | DEFTVDFSSQASYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVRSVSQ AQATECQIVGDRAAIAVNNVLWEANTIAALLNRKPQDLTEP NQ |
| SEQ ID NO: 1130 | SLT-2A1-Lys (11) | DEFTVDFSSQKSYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVR |
| SEQ ID NO: 1131 | SLT-2A-Lys (255) with amino-terminal truncation | SYVDSLNSIRSAISTPLGNISQGGVSVSVINHVLGGNYISLNV RGLDPYSERFNHLRLIMERNNLYVAGFINTETNIFYRFSDFSH ISVPDVITVSMTTDSSYSSLQRIADLERTGMQIGRHSLVGSYL DLMEFRGRSMTRASSRAMLRFVTVIAEALRFRQIQRGFRPAL SEASPLYTMTAQDVDLTLNWGRISNVLPEYRGEEGVRIGRIS FNSLSAILGSVAVILNCHSTGSYSVRSVSQKQATECQIVGDR AAIAVNNVLWEANTIAALLNRAPQDLTEPNQ |
| SEQ ID NO: 1132 | SLT-2A-Lys (257) with amino-terminal truncation | SYVDSLNSIRSAISTPLGNISQGGVSVSVINHVLGGNYISLNV RGLDPYSERFNHLRLIMERNNLYVAGFINTETNIFYRFSDFSH ISVPDVITVSMTTDSSYSSLQRIADLERTGMQIGRHSLVGSYL DLMEFRGRSMTRASSRAMLRFVTVIAEALRFRQIQRGFRPAL SEASPLYTMTAQDVDLTLNWGRISNVLPEYRGEEGVRIGRIS FNSLSAILGSVAVILNCHSTGSYSVRSVSQAQKTECQIVGDR AAIAVNNVLWEANTIAALLNRAPQDLTEPNQ |
| SEQ ID NO: 1133 | SLT-2A-Lys (270) with amino-terminal truncation | SYVDSLNSIRSAISTPLGNISQGGVSVSVINHVLGGNYISLNV RGLDPYSERFNHLRLIMERNNLYVAGFINTETNIFYRFSDFSH ISVPDVITVSMTTDSSYSSLQRIADLERTGMQIGRHSLVGSYL DLMEFRGRSMTRASSRAMLRFVTVIAEALRFRQIQRGFRPAL SEASPLYTMTAQDVDLTLNWGRISNVLPEYRGEEGVRIGRIS FNSLSAILGSVAVILNCHSTGSYSVRSVSQAQATECQIVGDR AAIKVNNVLWEANTIAALLNRAPQDLTEPNQ |
| SEQ ID NO: 1134 | SLT-2A-Lys (288) with amino-terminal truncation | SYVDSLNSIRSAISTPLGNISQGGVSVSVINHVLGGNYISLNV RGLDPYSERFNHLRLIMERNNLYVAGFINTETNIFYRFSDFSH ISVPDVITVSMTTDSSYSSLQRIADLERTGMQIGRHSLVGSYL DLMEFRGRSMTRASSRAMLRFVTVIAEALRFRQIQRGFRPAL |

-continued

Sequence Listing

| ID Number | Text Description | Biological Sequence |
|---|---|---|
| | | SEASPLYTMTAQDVDLTLNWGRISNVLPEYRGEEGVRIGRIS FNSLSAILGSVAVILNCHSTGSYSVRSVSQAQATECQIVGDR AAIAVNNVLWEANTIAALLNRKPQDLTEPNQ |
| SEQ ID NO: 1135 | SLT-2A-Lys (255) with carboxy-terminal truncation | DEFTVDFSSQASYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVRSVSQ K |
| SEQ ID NO: 1136 | SLT-2A-Lys (257) with carboxy-terminal truncation | DEFTVDFSSQASYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVRSVSQ AQK |
| SEQ ID NO: 1137 | SLT-2A-Lys (270) with carboxy-terminal truncation | DEFTVDFSSQASYVDSLNSIRSAISTPLGNISQGGVSVSVINH VLGGNYISLNVRGLDPYSERFNHLRLIMERNNLYVAGFINTE TNIFYRFSDFSHISVPDVITVSMTTDSSYSSLQRIADLERTGM QIGRHSLVGSYLDLMEFRGRSMTRASSRAMLRFVTVIAEAL RFRQIQRGFRPALSEASPLYTMTAQDVDLTLNWGRISNVLPE YRGEEGVRIGRISFNSLSAILGSVAVILNCHSTGSYSVRSVSQ AQATECQIVGDRAAIK |
| SEQ ID NO: 1138 | SLT-2A-Lys (255) with amino-and carboxy-terminal truncations | SYVDSLNSIRSAISTPLGNISQGGVSVSVINHVLGGNYISLNV RGLDPYSERFNHLRLIMERNNLYVAGFINTETNIFYRFSDFSH ISVPDVITVSMTTDSSYSSLQRIADLERTGMQIGRHSLVGSYL DLMEFRGRSMTRASSRAMLRFVTVIAEALRFRQIQRGFRPAL SEASPLYTMTAQDVDLTLNWGRISNVLPEYRGEEGVRIGRIS FNSLSAILGSVAVILNCHSTGSYSVRSVSQK |
| SEQ ID NO: 1139 | SLT-2A-Lys (257) with amino-and carboxy-terminal truncations | SYVDSLNSIRSAISTPLGNISQGGVSVSVINHVLGGNYISLNV RGLDPYSERFNHLRLIMERNNLYVAGFINTETNIFYRFSDFSH ISVPDVITVSMTTDSSYSSLQRIADLERTGMQIGRHSLVGSYL DLMEFRGRSMTRASSRAMLRFVTVIAEALRFRQIQRGFRPAL SEASPLYTMTAQDVDLTLNWGRISNVLPEYRGEEGVRIGRIS FNSLSAILGSVAVILNCHSTGSYSVRSVSQAQK |
| SEQ ID NO: 1140 | SLT-2A-Lys (270) with amino-and carboxy-terminal truncations | SYVDSLNSIRSAISTPLGNISQGGVSVSVINHVLGGNYISLNV RGLDPYSERFNHLRLIMERNNLYVAGFINTETNIFYRFSDFSH ISVPDVITVSMTTDSSYSSLQRIADLERTGMQIGRHSLVGSYL DLMEFRGRSMTRASSRAMLRFVTVIAEALRFRQIQRGFRPAL SEASPLYTMTAQDVDLTLNWGRISNVLPEYRGEEGVRIGRIS FNSLSAILGSVAVILNCHSTGSYSVRSVSQAQATECQIVGDR AAIK |
| SEQ ID NO: 1141 | IA-SLT-1A-Cys5-D1::scFv2 | MKEFTLDFSTAKTYVDSLNVIRSAIGTPLQTISCGGTSLLMID SGIGDNLFAVDILGFDFTLGRFNNLRLIVERNNLYVTGFVNR TNNVFYRFADFSHVTFPGTTAVTLSADSSYTTLQRVAGISRT GMQINRHSLTTSYLDLMSHSGTSLTQSVARAMLRFVTVTAD ALRFRQIQRGFRTTLDDLSGASYVMTAEDVDLTLNWGRLSS VLPDYHGQDSVRVGRISFGSINAILGSVALILNSHHHASAVA AEFPKPSTPPGSSGGAPDIQMTQSPSSLSASVGDRVTITCKAS EDIYNRLTWYQQKPGKAPKLLISGATSLETGVPSRFSGSGSG TDFTFTISSLQPEDIATYYCQQYWSNPYTFGQGTKVEIKGGG GSQVQLQESGPGLVRPSQTLSLTCTVSGFSLTSYGVHWVRQ PPGRGLEWIGVMWRGGSTDYNAAFMSRLNITKDNSKNQVS LRLSSVTAADTAVYYCAKSMITTGFVMDSWGQGSLVTVSS |

SEQUENCE LISTING (1239 sequences)

SEQ ID NO: 1 - protein, 293 aa, Escherichia coli
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 2 - protein, 293 aa, Shigella dysenteriae
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 3 - protein, 297 aa, Escherichia coli
DEFTVDFSSQKSYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQKQKTECQIVGDRAAIKVNNVLWEANTIAALLNRKPQDLTEPNQ

SEQ ID NO: 4 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 5 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 6 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 7 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 8 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 9 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 10 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 11 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 12 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHCGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 13 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLCGRSYVMTAEDVDLTLNWGRLSSVLPDYHGQDSVRVGRISFGSINAILGSVALILNSHHHASRVAR

SEQ ID NO: 14 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDCRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 15 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 16 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 17 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 18 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 19 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 20 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 21 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 22 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHCGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 23 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLCGRSYVMTAEDVDLTLNWGRLSSVLPDYHGQDSVRVGRISFGSINAILGSVALILNSHHHASAVAA

SEQ ID NO: 24 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDCRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 25 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 26 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 27 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 28 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 29 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 30 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 31 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 32 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 33 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASRVAR

SEQ ID NO: 34 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 35 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 36 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 37 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 38 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 39 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 40 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 41 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 42 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 43 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASRVAR

SEQ ID NO: 44 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 45 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 46 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 47 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 48 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 49 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 50 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 51 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 52 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHCGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 53 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLCGRSYVMTAEDVDLTLNWGRLSSVLPDYHGQDSVRVGRISFGSINAILGSVALILNSHHHASRVAR

SEQ ID NO: 54 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDCRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 55 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 56 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 57 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 58 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 59 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 60 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 61 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 62 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHCGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 63 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLCGRSYVMTAEDVDLTLNWGRLSSVLPDYHGQDSVRVGRISFGSINAILGSVALILNSHHHASAVAA

SEQ ID NO: 64 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDCRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 65 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 66 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 67 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 68 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 69 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 70 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 71 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 72 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHCGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 73 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLCGASYVMTAEDVDLTLNWGRLSSVLPDYHGQDSVRVGRISFGSINAILGSVALILNSHHHASRVAR

SEQ ID NO: 74 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 75 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 76 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 77 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 78 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 79 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 80 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 81 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 82 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHCATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 83 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLCGASYVMTAEDVDLTLNWGRLSSVLPDYHGQDSVRVGRISFGSINAILGSVALILNSHHHASRVAR

SEQ ID NO: 84 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 85 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 86 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 87 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 88 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 89 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 90 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 91 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 92 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 93 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASAVAA

SEQ ID NO: 94 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 95 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 96 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 97 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 98 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 99 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 100 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 101 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 102 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 103 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASAVAA

SEQ ID NO: 104 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 105 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 106 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 107 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 108 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 109 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 110 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 111 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 112 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHCGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 113 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLCGASYVMTAEDVDLTLNWGRLSSVLPDYHGQDSVRVGRISFGSINAILGSVALILNSHHHASAVAA

SEQ ID NO: 114 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 115 - protein, 251 aa, Artificial Sequence
  source: /note="Description of Artificial Sequence: Synthetic polypeptide"
CEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 116 - protein, 251 aa, Artificial Sequence
  source: /note="Description of Artificial Sequence: Synthetic polypeptide"
KEFTLDFCTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 117 - protein, 251 aa, Artificial Sequence
  source: /note="Description of Artificial Sequence: Synthetic polypeptide"
KEFTLDFSTAKTYVDCLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 118 - protein, 251 aa, Artificial Sequence
  source: /note="Description of Artificial Sequence: Synthetic polypeptide"
KEFTLDFSTAKTYVDSLNVIRCAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 119 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 120 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDCGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 121 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 122 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHCATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 123 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLCGASYVMTAEDVDLTLNWGRLSSVLPDYHGQDSVRVGRISFGSINAILGSVALILNSHHHASAVAA

SEQ ID NO: 124 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDCRGIDPEEGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 125 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 126 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 127 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 128 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 129 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 130 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 131 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 132 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 133 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 134 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 135 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 136 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 137 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 138 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 139 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 140 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 141 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 142 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 143 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 144 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 145 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 146 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 147 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 148 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 149 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 150 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 151 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 152 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 153 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 154 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 155 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 156 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 157 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 158 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 159 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 160 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 161 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 162 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 163 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 164 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 165 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 166 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 167 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 168 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 169 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 170 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 171 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 172 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 173 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 174 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 175 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 176 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 177 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 178 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 179 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 180 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 181 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 182 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 183 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 184 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 185 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 186 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 187 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 188 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 189 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 190 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 191 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 192 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 193 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 194 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 195 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 196 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 197 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 198 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 199 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 200 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 201 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 202 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 203 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 204 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 205 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 206 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 207 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 208 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 209 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 210 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 211 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 212 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 213 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 214 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 215 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 216 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 217 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 218 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 219 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 220 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 221 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 222 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 223 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 224 - protein, 251 aa, Artificial Sequence
  source: /note="Description of Artificial Sequence: Synthetic polypeptide"
KEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 225 - protein, 251 aa, Artificial Sequence
  source: /note="Description of Artificial Sequence: Synthetic polypeptide"
KEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 226 - protein, 251 aa, Artificial Sequence
  source: /note="Description of Artificial Sequence: Synthetic polypeptide"
KEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 227 - protein, 251 aa, Artificial Sequence
  source: /note="Description of Artificial Sequence: Synthetic polypeptide"
KEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 228 - protein, 251 aa, Artificial Sequence
  source: /note="Description of Artificial Sequence: Synthetic polypeptide"
REFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 229 - protein, 251 aa, Artificial Sequence
  source: /note="Description of Artificial Sequence: Synthetic polypeptide"
HEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 230 - protein, 251 aa, Artificial Sequence
  source: /note="Description of Artificial Sequence: Synthetic polypeptide"
DEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 231 - protein, 251 aa, Artificial Sequence
  source: /note="Description of Artificial Sequence: Synthetic polypeptide"
QEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 232 - protein, 251 aa, Artificial Sequence
  source: /note="Description of Artificial Sequence: Synthetic polypeptide"
SEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 233 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 234 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 235 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 236 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 237 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 238 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 239 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 240 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 241 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 242 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 243 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 244 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 245 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 246 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 247 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 248 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 249 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 250 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 251 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 252 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 253 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 254 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 255 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 256 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 257 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 258 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 259 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 260 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 261 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 262 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 263 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 264 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 265 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 266 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 267 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 268 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 269 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 270 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 271 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 272 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 273 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 274 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 275 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 276 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 277 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 278 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 279 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 280 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 281 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 282 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 283 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 284 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 285 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 286 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 287 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 288 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 289 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 290 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 291 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 292 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 293 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 294 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 295 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 296 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 297 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 298 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 299 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 300 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 301 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 302 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 303 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 304 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 305 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 306 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 307 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 308 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 309 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 310 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 311 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 312 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 313 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 314 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 315 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 316 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 317 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 318 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 319 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 320 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 321 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 322 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 323 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 324 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 325 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 326 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 327 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 328 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 329 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 330 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 331 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 332 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 333 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 334 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 335 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 336 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 337 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 338 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 339 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 340 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 341 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 342 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 343 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 344 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 345 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 346 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 347 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 348 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 349 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 350 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 351 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 352 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 353 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 354 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 355 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 356 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 357 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 358 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 359 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 360 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 361 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 362 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 363 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 364 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 365 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 366 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 367 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 368 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 369 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 370 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 371 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 372 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 373 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 374 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 375 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 376 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 377 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 378 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 379 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 380 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 381 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 382 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 383 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 384 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 385 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 386 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 387 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 388 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 389 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 390 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 391 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 392 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 393 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSATSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 394 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLALMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASRVAR

SEQ ID NO: 395 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 396 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 397 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 398 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 399 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 400 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 401 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 402 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 403 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 404 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 405 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 406 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 407 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 408 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 409 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 410 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 411 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 412 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 413 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 414 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 415 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 416 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 417 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 418 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 419 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 420 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 421 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 422 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 423 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 424 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 425 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 426 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 427 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 428 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 429 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 430 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 431 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 432 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 433 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 434 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 435 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 436 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 437 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 438 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 439 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 440 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 441 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 442 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 443 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 444 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 445 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 446 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 447 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 448 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 449 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 450 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 451 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 452 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 453 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 454 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 455 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 456 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 457 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 458 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 459 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 460 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 461 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 462 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 463 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 464 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 465 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 466 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 467 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 468 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 469 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 470 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 471 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 472 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 473 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 474 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNCHHHASAVAA

SEQ ID NO: 475 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSATSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASAVAA

SEQ ID NO: 476 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLALMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 477 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 478 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 479 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 480 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 481 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 482 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 483 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 484 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 485 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 486 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 487 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 488 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 489 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 490 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 491 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 492 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 493 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 494 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 495 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 496 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 497 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 498 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 499 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 500 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 501 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 502 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 503 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 504 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 505 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 506 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 507 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 508 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 509 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 510 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 511 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 512 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 513 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 514 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 515 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 516 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 517 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 518 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 519 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 520 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 521 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 522 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 523 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 524 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 525 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 526 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 527 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 528 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 529 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 530 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 531 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 532 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 533 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 534 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 535 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 536 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 537 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 538 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 539 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 540 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 541 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 542 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 543 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 544 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 545 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 546 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 547 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 548 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 549 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 550 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 551 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 552 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 553 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 554 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 555 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 556 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASRVAR

SEQ ID NO: 557 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 558 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 559 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 560 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 561 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 562 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 563 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 564 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 565 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 566 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 567 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 568 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 569 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 570 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 571 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 572 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 573 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 574 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 575 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 576 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 577 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 578 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 579 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 580 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 581 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 582 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 583 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 584 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 585 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 586 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 587 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 588 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 589 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 590 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 591 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 592 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 593 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 594 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 595 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 596 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 597 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 598 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 599 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 600 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 601 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 602 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 603 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 604 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 605 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 606 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 607 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 608 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 609 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 610 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 611 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 612 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 613 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 614 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 615 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 616 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 617 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 618 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 619 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 620 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 621 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 622 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 623 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 624 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 625 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 626 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 627 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 628 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 629 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 630 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 631 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 632 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 633 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 634 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 635 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 636 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 637 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSATSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 638 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLALMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 639 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 640 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 641 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 642 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 643 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 644 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 645 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 646 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 647 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 648 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 649 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 650 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 651 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 652 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 653 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 654 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 655 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 656 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 657 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 658 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 659 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 660 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 661 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 662 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 663 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 664 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 665 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 666 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 667 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 668 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 669 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 670 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 671 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 672 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 673 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 674 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 675 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 676 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 677 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 678 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 679 - protein, 251 aa, Artificial Sequence; identical to SEQ ID NO: 435
  source: /note="Description of Artificial Sequence: Synthetic polypeptide"

SEQ ID NO: 680 - protein, 251 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 681 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 682 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 683 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 684 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 685 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 686 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 687 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 688 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 689 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 690 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 691 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 692 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 693 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 694 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 695 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 696 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 697 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 698 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 699 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 700 - protein, 251 aa, Artificial Sequence
  source: /note="Description of Artificial Sequence: Synthetic polypeptide"
HEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 701 - protein, 251 aa, Artificial Sequence
  source: /note="Description of Artificial Sequence: Synthetic polypeptide"
DEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 702 - protein, 251 aa, Artificial Sequence
  source: /note="Description of Artificial Sequence: Synthetic polypeptide"
QEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 703 - protein, 251 aa, Artificial Sequence
  source: /note="Description of Artificial Sequence: Synthetic polypeptide"
SEFTLDFSTARTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 704 - protein, 251 aa, Artificial Sequence
  source: /note="Description of Artificial Sequence: Synthetic polypeptide"
REFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 705 - protein, 251 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 706 - protein, 251 aa, Artificial Sequence
  source: /note="Description of Artificial Sequence: Synthetic polypeptide"
DEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 707 - protein, 251 aa, Artificial Sequence
  source: /note="Description of Artificial Sequence: Synthetic polypeptide"
QEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 708 - protein, 251 aa, Artificial Sequence
  source: /note="Description of Artificial Sequence: Synthetic polypeptide"
SEFTLDFSTAHTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 709 - protein, 251 aa, Artificial Sequence
  source: /note="Description of Artificial Sequence: Synthetic polypeptide"
REFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 710 - protein, 251 aa, Artificial Sequence
  source: /note="Description of Artificial Sequence: Synthetic polypeptide"
HEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 711 - protein, 251 aa, Artificial Sequence
  source: /note="Description of Artificial Sequence: Synthetic polypeptide"
DEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 712 - protein, 251 aa, Artificial Sequence
  source: /note="Description of Artificial Sequence: Synthetic polypeptide"
QEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 713 - protein, 251 aa, Artificial Sequence
  source: /note="Description of Artificial Sequence: Synthetic polypeptide"
SEFTLDFSTAQTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 714 - protein, 251 aa, Artificial Sequence
  source: /note="Description of Artificial Sequence: Synthetic polypeptide"
REFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 715 - protein, 251 aa, Artificial Sequence
  source: /note="Description of Artificial Sequence: Synthetic polypeptide"
HEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 716 - protein, 251 aa, Artificial Sequence
  source: /note="Description of Artificial Sequence: Synthetic polypeptide"
DEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 717 - protein, 251 aa, Artificial Sequence
  source: /note="Description of Artificial Sequence: Synthetic polypeptide"
QEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 718 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 719 - protein, 251 aa, Artificial Sequence
  source: /note="Description of Artificial Sequence: Synthetic polypeptide"
SEFTLDFSTASTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSATSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 720 - protein, 251 aa, Artificial Sequence; identical to SEQ ID NO: 476
  source: /note="Description of Artificial Sequence: Synthetic polypeptide"

SEQ ID NO: 721 - protein, 251 aa, Artificial Sequence; identical to SEQ ID NO: 4
  source: /note="Description of Artificial Sequence: Synthetic polypeptide"

SEQ ID NO: 722 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 723 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 724 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 725 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASRVAR

SEQ ID NO: 726 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNSHHHASAVAA

SEQ ID NO: 727 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 728 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASRVAR

SEQ ID NO: 729 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 730 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 731 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 732 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 733 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNAHHHASRVAR

SEQ ID NO: 734 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNAHHHASAVAA

SEQ ID NO: 735 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNAHHHASRVAR

SEQ ID NO: 736 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNAHHHASRVAR

SEQ ID NO: 737 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNAHHHASRVAR

SEQ ID NO: 738 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNAHHHASAVAA

SEQ ID NO: 739 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNAHHHASRVAR

SEQ ID NO: 740 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNAHHHASRVAR

SEQ ID NO: 741 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNAHHHASAVAA

SEQ ID NO: 742 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNAHHHASAVAA

SEQ ID NO: 743 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNAHHHASAVAA

SEQ ID NO: 744 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNAHHHASAVAA

SEQ ID NO: 745 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNVHHHASRVAR

SEQ ID NO: 746 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNVHHHASRVAR

SEQ ID NO: 747 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNVHHHASAVAA

SEQ ID NO: 748 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNVHHHASRVAR

SEQ ID NO: 749 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNVHHHASRVAR

SEQ ID NO: 750 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNVHHHASAVAA

SEQ ID NO: 751 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNVHHHASRVAR

SEQ ID NO: 752 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNVHHHASRVAR

SEQ ID NO: 753 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNVHHHASAVAA

SEQ ID NO: 754 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNVHHHASAVAA

SEQ ID NO: 755 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNVHHHASAVAA

SEQ ID NO: 756 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSATSLTQSVARAMLRFVTVTADALRFRQIQRGFRTTLDDLSGASYVMTAEDVDLTLNWGRLSSVLPDYHGQDSVRVGRISFGSINAILGSVALILNVHHHASAVAA

SEQ ID NO: 757 - protein, 16 aa, Artificial Sequence
  source: /note="Description of Artificial Sequence: Synthetic peptide"
EFPKPCTPPGSSGGAP

SEQ ID NO: 758 - protein, 16 aa, Artificial Sequence
  source: /note="Description of Artificial Sequence: Synthetic peptide"
EFPKPSTPPGSCGGAP

SEQ ID NO: 759 - protein, 15 aa, Artificial Sequence
  source: /note="Description of Artificial Sequence: Synthetic peptide"
AHHCEDPSSKAPKAP

SEQ ID NO: 760 - protein, 15 aa, Artificial Sequence
  source: /note="Description of Artificial Sequence: Synthetic peptide"
AHHSEDPSCKAPKAP

SEQ ID NO: 761 - protein, 16 aa, Artificial Sequence
  source: /note="Description of Artificial Sequence: Synthetic peptide"
EFPKPSTPPGSSGGAP

SEQ ID NO: 762 - protein, 267 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPCTPPGSSGGAP

SEQ ID NO: 763 - protein, 267 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPCTPPGSSGGAP

SEQ ID NO: 764 - protein, 267 aa, Artificial Sequence
  source: /note="Description of Artificial Sequence: Synthetic polypeptide"
REFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAP

SEQ ID NO: 765 - protein, 267 aa, Artificial Sequence
  source: /note="Description of Artificial Sequence: Synthetic polypeptide"
HEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAP

SEQ ID NO: 766 - protein, 267 aa, Artificial Sequence
  source: /note="Description of Artificial Sequence: Synthetic polypeptide"
SEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAP

SEQ ID NO: 767 - protein, 267 aa, Artificial Sequence; identical to SEQ ID NO: 764
  source: /note="Description of Artificial Sequence: Synthetic polypeptide"

SEQ ID NO: 768 - protein, 16 aa, Artificial Sequence
  source: /note="Description of Artificial Sequence: Synthetic peptide"
SPSTPPTPSPSTPPAS

SEQ ID NO: 769 - protein, 5 aa, Artificial Sequence
  source: /note="Description of Artificial Sequence: Synthetic peptide"
GGGGC

SEQ ID NO: 770 - protein, 25 aa, Artificial Sequence
  source: /note="Description of Artificial Sequence: Synthetic peptide"
GGGGSGGGGSGGGGCGGGGSGGGGS

SEQ ID NO: 771 - protein, 15 aa, Artificial Sequence
  source: /note="Description of Artificial Sequence: Synthetic peptide"
GSTSGCGKPGSGEGS

SEQ ID NO: 772 - protein, 18 aa, Artificial Sequence
  source: /note="Description of Artificial Sequence: Synthetic peptide"
GSTSGCGKPGSGEGSTKG

SEQ ID NO: 773 - protein, 499 aa, Artificial Sequence
  source: /note="Description of Artificial Sequence: Synthetic polypeptide"
MKEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 774 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDCGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 775 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 776 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 777 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 778 - protein, 519 aa, Artificial Sequence
  source: /note="Description of Artificial Sequence: Synthetic polypeptide"
MKEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSGGGGSGGGGSGGGGSGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 779 - protein, 519 aa, Artificial Sequence
  source: /note="Description of Artificial Sequence: Synthetic polypeptide"
MKEFTLDFSTAKTYVDCLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSGGGGSGGGGSGGGGSGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 780 - protein, 519 aa, Artificial Sequence
  source: /note="Description of Artificial Sequence: Synthetic polypeptide"
MKEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSGGGGSGGGGSGGGGSGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 781 - protein, 513 aa, Artificial Sequence
  source: /note="Description of Artificial Sequence: Synthetic polypeptide"
MKEFTLDFSTAKTYVDSLNVIRSAIGTPLQTISCGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITVRASQDVNTAVAWYQQKPGKAPKLLIYSASFLYSGVPSRFSGSRSGTDFTLTISSLQPEDFATYYAQQHYTTPPTFGQGTKVEIKRTGSTSGSGKPGSGEGSEVQLVESGGGLVQPGGSLRLSVAASGFNIKDTYIHWVRQAPGKGLEWVARIYPTNGYTRYADSVKGRFTISADTSKNTAYLQMNSLRAEDTAVYYASRWGGDGFYAMDVWGQGTLVTVSSA

SEQ ID NO: 782 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGCGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITVRASQDVNTAVAWYQQKPGKAPKLLIYSASFLYSGVPSRFSGSRSGTDFTLTISSLQPEDFATYYAQQHYTTPPTFGQGTKVEIKRTGSTSGSGKPGSGEGSEVQLVESGGGLVQPGGSLRLSVAASGFNIKDTYIHWVRQAPGKGLEWVARIYPTNGYTRYADSVKGRFTISADTSKNTAYLQMNSLRAEDTAVYYASRWGGDGFYAMDVWGQGTLVTVSSA

SEQ ID NO: 783 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDCRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITVRASQDVNTAVAWYQQKPGKAPKLLIYSASFLYSGVPSRFSGSRSGTDFTLTISSLQPEDFATYYAQQHYTTPPTFGQGTKVEIKRTGSTSGSGKPGSGEGSEVQLVESGGGLVQPGGSLRLSVAASGFNIKDTYIHWVRQAPGKGLEWVARIYPTNGYTRYADSVKGRFTISADTSKNTAYLQMNSLRAEDTAVYYASRWGGDGFYAMDVWGQGTLVTVSSA

SEQ ID NO: 784 - protein, 513 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGSTSGSGKPGSGEGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSEFPKPSTPPGSSGGAPKEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 785 - protein, 513 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGSTSGSGKPGSGEGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSEFPKPSTPPGSSGGAPKEFTLDFSTAKTYVDSLNVIRSAIGTPLQTISSGGTSLLMIDCGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 786 - protein, 513 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGSTSGSGKPGSGEGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 787 - protein, 513 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGSTSGSGKPGSGEGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASRVAR

SEQ ID NO: 788 - protein, 386 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSA

SEQ ID NO: 789 - protein, 499 aa, Artificial Sequence
  source: /note="Description of Artificial Sequence: Synthetic polypeptide"
MKEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 790 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDCGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 791 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 792 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLCGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 793 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 794 - protein, 519 aa, Artificial Sequence
  source: /note="Description of Artificial Sequence: Synthetic polypeptide"
MKEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 795 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 796 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLCGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 797 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 798 - protein, 519 aa, Artificial Sequence
  source: /note="Description of Artificial Sequence: Synthetic polypeptide"
MKEFTLDFCTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 799 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 800 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLCGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 801 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 802 - protein, 499 aa, Artificial Sequence
  source: /note="Description of Artificial Sequence: Synthetic polypeptide"
MKEFTLDFSTAKTYVDSLNVIRCAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 803 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPCTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 804 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPCTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 805 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPCTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 806 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPCTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 807 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGCQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 808 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGCQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 809 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGCGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 810 - protein, 519 aa, Artificial Sequence; identical to SEQ ID NO: 809
  source: /note="Description of Artificial Sequence: Synthetic polypeptide"

SEQ ID NO: 811 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGCGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 812 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVCS

SEQ ID NO: 813 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVCS

SEQ ID NO: 814 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVCS

SEQ ID NO: 815 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVCS

SEQ ID NO: 816 - protein, 386 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSCA

SEQ ID NO: 817 - protein, 386 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLSVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSCA

SEQ ID NO: 818 - protein, 519 aa, Artificial Sequence
  source: /note="Description of Artificial Sequence: Synthetic polypeptide"
MKEFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 819 - protein, 519 aa, Artificial Sequence
  source: /note="Description of Artificial Sequence: Synthetic polypeptide"
MKEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 820 - protein, 519 aa, Artificial Sequence
  source: /note="Description of Artificial Sequence: Synthetic polypeptide"
MKEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 821 - protein, 519 aa, Artificial Sequence
  source: /note="Description of Artificial Sequence: Synthetic polypeptide"
MREFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 822 - protein, 519 aa, Artificial Sequence
  source: /note="Description of Artificial Sequence: Synthetic polypeptide"
MHEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 823 - protein, 519 aa, Artificial Sequence
  source: /note="Description of Artificial Sequence: Synthetic polypeptide"
MSEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 824 - protein, 519 aa, Artificial Sequence
  source: /note="Description of Artificial Sequence: Synthetic polypeptide"
MREFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 825 - protein, 519 aa, Artificial Sequence
  source: /note="Description of Artificial Sequence: Synthetic polypeptide"
MHEFTLDFSTAHTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 826 - protein, 519 aa, Artificial Sequence
  source: /note="Description of Artificial Sequence: Synthetic polypeptide"
MSEFTLDFSTASTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 827 - protein, 519 aa, Artificial Sequence
  source: /note="Description of Artificial Sequence: Synthetic polypeptide"
MREFTLDFSTARTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAASPSTPPTPSPSTPPASQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 828 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 829 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAASPSTPPTPSPSTPPASQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSGGGGSGGGGSDIQMTQSPSSLSASVGDRVTITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 830 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 831 - protein, 251 aa, Artificial Sequence; identical to SEQ ID NO: 729
  source: /note="Description of Artificial Sequence: Synthetic polypeptide"

SEQ ID NO: 832 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 833 - protein, 251 aa, Artificial Sequence; identical to SEQ ID NO: 724
  source: /note="Description of Artificial Sequence: Synthetic polypeptide"

SEQ ID NO: 834 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 835 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 836 - protein, 513 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGSTSGSGKPGSGEGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 837 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSGGGGSGGGGSGGGGSGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 838 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 839 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSGGGGSGGGGSGGGGSGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 840 - protein, 513 aa, Artificial Sequence
  source: /note="Description of Artificial Sequence: Synthetic polypeptide"
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGSTSGSGKPGSGEGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSEFPKPSTPPGSSGGAPKEFTLDFSTAKTYVDSLNVIRSAIGTPLQTISSGGTSLLMIDSGSGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASRVAR

SEQ ID NO: 841 - protein, 386 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAAHHSEDPSSKAPKAPEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSA

SEQ ID NO: 842 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 843 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 844 - protein, 9 aa, Artificial Sequence
  source: /note="Description of Artificial Sequence: Synthetic peptide"
YTFTSYVMH

SEQ ID NO: 845 - protein, 14 aa, Artificial Sequence
  source: /note="Description of Artificial Sequence: Synthetic peptide"
WIGYINPYNDGTKY

SEQ ID NO: 846 - protein, 13 aa, Artificial Sequence
  source: /note="Description of Artificial Sequence: Synthetic peptide"
RGTYYYGSRVFDY

SEQ ID NO: 847 - protein, 13 aa, Artificial Sequence
  source: /note="Description of Artificial Sequence: Synthetic peptide"
KSLLNSNGNTYLY

SEQ ID NO: 848 - protein, 11 aa, Artificial Sequence
  source: /note="Description of Artificial Sequence: Synthetic peptide"
LLIYRMSNLAS

SEQ ID NO: 849 - protein, 8 aa, Artificial Sequence
  source: /note="Description of Artificial Sequence: Synthetic peptide"
MQHLEYPF

SEQ ID NO: 850 - protein, 9 aa, Artificial Sequence
  source: /note="Description of Artificial Sequence: Synthetic peptide"
YAFSSYWMN

SEQ ID NO: 851 - protein, 14 aa, Artificial Sequence
  source: /note="Description of Artificial Sequence: Synthetic peptide"
WIGQIWPGDGDTNY

SEQ ID NO: 852 - protein, 16 aa, Artificial Sequence
  source: /note="Description of Artificial Sequence: Synthetic peptide"
RRETTTVGRYYYAMDY

SEQ ID NO: 853 - protein, 12 aa, Artificial Sequence
  source: /note="Description of Artificial Sequence: Synthetic peptide"
QSVDYDGDSYLN

SEQ ID NO: 854 - protein, 11 aa, Artificial Sequence
  source: /note="Description of Artificial Sequence: Synthetic peptide"
LLIYDASNLVS

SEQ ID NO: 855 - protein, 8 aa, Artificial Sequence
  source: /note="Description of Artificial Sequence: Synthetic peptide"
QQSTEDPW

SEQ ID NO: 856 - protein, 16 aa, Artificial Sequence
  source: /note="Description of Artificial Sequence: Synthetic peptide"
WIGQIWPGDGDTNYNG

SEQ ID NO: 857 - protein, 11 aa, Artificial Sequence
  source: /note="Description of Artificial Sequence: Synthetic peptide"
GSISTSGMGVG

SEQ ID NO: 858 - protein, 13 aa, Artificial Sequence
  source: /note="Description of Artificial Sequence: Synthetic peptide"
WIGHIWWDDDKRY

SEQ ID NO: 859 - protein, 11 aa, Artificial Sequence
  source: /note="Description of Artificial Sequence: Synthetic peptide"
RMELWSYYFDY

SEQ ID NO: 860 - protein, 7 aa, Artificial Sequence
  source: /note="Description of Artificial Sequence: Synthetic peptide"
SSVSYMH

SEQ ID NO: 861 - protein, 11 aa, Artificial Sequence
  source: /note="Description of Artificial Sequence: Synthetic peptide"
LLIYDTSKLAS

SEQ ID NO: 862 - protein, 8 aa, Artificial Sequence
  source: /note="Description of Artificial Sequence: Synthetic peptide"
FQGSVYPF

SEQ ID NO: 863 - protein, 10 aa, Artificial Sequence
  source: /note="Description of Artificial Sequence: Synthetic peptide"
GYTFTSYNMH

SEQ ID NO: 864 - protein, 17 aa, Artificial Sequence
  source: /note="Description of Artificial Sequence: Synthetic peptide"
AIYPGNGDTSYNQKFKG

SEQ ID NO: 865 - protein, 12 aa, Artificial Sequence
  source: /note="Description of Artificial Sequence: Synthetic peptide"
AQLRPNYWYFDV

SEQ ID NO: 866 - protein, 10 aa, Artificial Sequence
  source: /note="Description of Artificial Sequence: Synthetic peptide"
RASSSVSYMH

SEQ ID NO: 867 - protein, 7 aa, Artificial Sequence
  source: /note="Description of Artificial Sequence: Synthetic peptide"
ATSNLAS

SEQ ID NO: 868 - protein, 9 aa, Artificial Sequence
  source: /note="Description of Artificial Sequence: Synthetic peptide"
QQWISNPPT

SEQ ID NO: 869 - protein, 10 aa, Artificial Sequence
  source: /note="Description of Artificial Sequence: Synthetic peptide"
GYTFTSYNVH

SEQ ID NO: 870 - protein, 14 aa, Artificial Sequence
  source: /note="Description of Artificial Sequence: Synthetic peptide"
SNYYGSSYVWFFDV

SEQ ID NO: 871 - protein, 10 aa, Artificial Sequence
  source: /note="Description of Artificial Sequence: Synthetic peptide"
RASSSVSYMD

SEQ ID NO: 872 - protein, 12 aa, Artificial Sequence
  source: /note="Description of Artificial Sequence: Synthetic peptide"
STYYGGDWYFNV

SEQ ID NO: 873 - protein, 10 aa, Artificial Sequence
  source: /note="Description of Artificial Sequence: Synthetic peptide"
RASSSVSYIH

SEQ ID NO: 874 - protein, 9 aa, Artificial Sequence
  source: /note="Description of Artificial Sequence: Synthetic peptide"
QQWTSNPPT

SEQ ID NO: 875 - protein, 10 aa, Artificial Sequence
  source: /note="Description of Artificial Sequence: Synthetic peptide"
GFTFNDYAMH

SEQ ID NO: 876 - protein, 17 aa, Artificial Sequence
  source: /note="Description of Artificial Sequence: Synthetic peptide"
TISWNSGSIGYADSVKG

SEQ ID NO: 877 - protein, 13 aa, Artificial Sequence
  source: /note="Description of Artificial Sequence: Synthetic peptide"
DIQYGNYYYGMDV

SEQ ID NO: 878 - protein, 11 aa, Artificial Sequence
  source: /note="Description of Artificial Sequence: Synthetic peptide"
RASQSVSSYLA

SEQ ID NO: 879 - protein, 7 aa, Artificial Sequence
  source: /note="Description of Artificial Sequence: Synthetic peptide"
DASNRAT

SEQ ID NO: 880 - protein, 9 aa, Artificial Sequence
  source: /note="Description of Artificial Sequence: Synthetic peptide"
QQRSNWPIT

SEQ ID NO: 881 - protein, 10 aa, Artificial Sequence
  source: /note="Description of Artificial Sequence: Synthetic peptide"
GYTFTSYNMH

SEQ ID NO: 882 - protein, 13 aa, Artificial Sequence
  source: /note="Description of Artificial Sequence: Synthetic peptide"
VVYYSNSYWYFDV

SEQ ID NO: 883 - protein, 7 aa, Artificial Sequence
  source: /note="Description of Artificial Sequence: Synthetic peptide"
APSNLAS

SEQ ID NO: 884 - protein, 9 aa, Artificial Sequence
  source: /note="Description of Artificial Sequence: Synthetic peptide"
QQWSFNPPT

SEQ ID NO: 885 - protein, 10 aa, Artificial Sequence
  source: /note="Description of Artificial Sequence: Synthetic peptide"
GYAFSYSWIN

SEQ ID NO: 886 - protein, 17 aa, Artificial Sequence
  source: /note="Description of Artificial Sequence: Synthetic peptide"
RIFPGDGDTDYNGKFKG

SEQ ID NO: 887 - protein, 10 aa, Artificial Sequence
  source: /note="Description of Artificial Sequence: Synthetic peptide"
NVFDGYWLVY

SEQ ID NO: 888 - protein, 16 aa, Artificial Sequence
  source: /note="Description of Artificial Sequence: Synthetic peptide"
RSSKSLLHSNGITYLY

SEQ ID NO: 889 - protein, 7 aa, Artificial Sequence
  source: /note="Description of Artificial Sequence: Synthetic peptide"
QMSNLVS

SEQ ID NO: 890 - protein, 9 aa, Artificial Sequence
  source: /note="Description of Artificial Sequence: Synthetic peptide"
AQNLELPYT

SEQ ID NO: 891 - protein, 9 aa, Artificial Sequence
  source: /note="Description of Artificial Sequence: Synthetic peptide"
YRFTNYWIH

SEQ ID NO: 892 - protein, 16 aa, Artificial Sequence
  source: /note="Description of Artificial Sequence: Synthetic peptide"
WIGGINPGNNYATYRR

SEQ ID NO: 893 - protein, 14 aa, Artificial Sequence
  source: /note="Description of Artificial Sequence: Synthetic peptide"
TREGYGNYGAWFAY

SEQ ID NO: 894 - protein, 13 aa, Artificial Sequence
  source: /note="Description of Artificial Sequence: Synthetic peptide"
QSLANSYGNTFLS

SEQ ID NO: 895 - protein, 11 aa, Artificial Sequence
  source: /note="Description of Artificial Sequence: Synthetic peptide"
LLIYGISNRFS

SEQ ID NO: 896 - protein, 8 aa, Artificial Sequence
  source: /note="Description of Artificial Sequence: Synthetic peptide"
LQGTHQPY

SEQ ID NO: 897 - protein, 9 aa, Artificial Sequence
  source: /note="Description of Artificial Sequence: Synthetic peptide"
FAFSIYDMS

SEQ ID NO: 898 - protein, 14 aa, Artificial Sequence
  source: /note="Description of Artificial Sequence: Synthetic peptide"
WVAYISSGGGTTYY

SEQ ID NO: 899 - protein, 15 aa, Artificial Sequence
  source: /note="Description of Artificial Sequence: Synthetic peptide"
RHSGYGTHWGVLFAY

SEQ ID NO: 900 - protein, 8 aa, Artificial Sequence
  source: /note="Description of Artificial Sequence: Synthetic peptide"
QDISNYLA

SEQ ID NO: 901 - protein, 11 aa, Artificial Sequence
  source: /note="Description of Artificial Sequence: Synthetic peptide"
LLIYYTSILHS

SEQ ID NO: 902 - protein, 8 aa, Artificial Sequence
  source: /note="Description of Artificial Sequence: Synthetic peptide"
QQGNTLPW

SEQ ID NO: 903 - protein, 9 aa, Artificial Sequence
  source: /note="Description of Artificial Sequence: Synthetic peptide"
YTFTSYWLH

SEQ ID NO: 904 - protein, 14 aa, Artificial Sequence
  source: /note="Description of Artificial Sequence: Synthetic peptide"
WIGYINPRNDYTEY

SEQ ID NO: 905 - protein, 8 aa, Artificial Sequence
  source: /note="Description of Artificial Sequence: Synthetic peptide"
RRDITTFY

SEQ ID NO: 906 - protein, 14 aa, Artificial Sequence
  source: /note="Description of Artificial Sequence: Synthetic peptide"
QSVLYSANHKNYLA

SEQ ID NO: 907 - protein, 11 aa, Artificial Sequence
  source: /note="Description of Artificial Sequence: Synthetic peptide"
LLIYWASTRES

SEQ ID NO: 908 - protein, 7 aa, Artificial Sequence
  source: /note="Description of Artificial Sequence: Synthetic peptide"
HQYLSSW

SEQ ID NO: 909 - protein, 9 aa, Artificial Sequence
  source: /note="Description of Artificial Sequence: Synthetic peptide"
YEFSRSWMN

SEQ ID NO: 910 - protein, 18 aa, Artificial Sequence
  source: /note="Description of Artificial Sequence: Synthetic peptide"
WVGRIYPGDGDTNYSGKF

SEQ ID NO: 911 - protein, 12 aa, Artificial Sequence
  source: /note="Description of Artificial Sequence: Synthetic peptide"
RDGSSWDWYFDV

SEQ ID NO: 912 - protein, 13 aa, Artificial Sequence
  source: /note="Description of Artificial Sequence: Synthetic peptide"
QSIVHSVGNTFLE

SEQ ID NO: 913 - protein, 11 aa, Artificial Sequence
  source: /note="Description of Artificial Sequence: Synthetic peptide"
LLIYKVSNRFS

SEQ ID NO: 914 - protein, 8 aa, Artificial Sequence
  source: /note="Description of Artificial Sequence: Synthetic peptide"
FQGSQFPY

SEQ ID NO: 915 - protein, 10 aa, Artificial Sequence
  source: /note="Description of Artificial Sequence: Synthetic peptide"
GYRFTNYWIH

SEQ ID NO: 916 - protein, 17 aa, Artificial Sequence
  source: /note="Description of Artificial Sequence: Synthetic peptide"
GINPGNNYATYRRKFQG

SEQ ID NO: 917 - protein, 12 aa, Artificial Sequence
  source: /note="Description of Artificial Sequence: Synthetic peptide"
EGYGNYGAWFAY

SEQ ID NO: 918 - protein, 16 aa, Artificial Sequence
  source: /note="Description of Artificial Sequence: Synthetic peptide"
RSSQSLANSYGNTFLS

SEQ ID NO: 919 - protein, 7 aa, Artificial Sequence
  source: /note="Description of Artificial Sequence: Synthetic peptide"
GISNRFS

SEQ ID NO: 920 - protein, 9 aa, Artificial Sequence
  source: /note="Description of Artificial Sequence: Synthetic peptide"
LQGTHQPYT

SEQ ID NO: 921 - protein, 10 aa, Artificial Sequence
  source: /note="Description of Artificial Sequence: Synthetic peptide"
GFAFSIYDMS

SEQ ID NO: 922 - protein, 17 aa, Artificial Sequence
  source: /note="Description of Artificial Sequence: Synthetic peptide"
YISSGGGTTYYPDTVKG

SEQ ID NO: 923 - protein, 14 aa, Artificial Sequence
  source: /note="Description of Artificial Sequence: Synthetic peptide"
HSGYGTHWGVLFAY

SEQ ID NO: 924 - protein, 11 aa, Artificial Sequence
  source: /note="Description of Artificial Sequence: Synthetic peptide"
RASQDISNYLA

SEQ ID NO: 925 - protein, 7 aa, Artificial Sequence
  source: /note="Description of Artificial Sequence: Synthetic peptide"
YTSILHS

SEQ ID NO: 926 - protein, 9 aa, Artificial Sequence
  source: /note="Description of Artificial Sequence: Synthetic peptide"
QQGNTLPWT

SEQ ID NO: 927 - protein, 10 aa, Artificial Sequence
  source: /note="Description of Artificial Sequence: Synthetic peptide"
GYTFTDYYIT

SEQ ID NO: 928 - protein, 15 aa, Artificial Sequence
  source: /note="Description of Artificial Sequence: Synthetic peptide"
WIYPGSGNTKYNEKF

SEQ ID NO: 929 - protein, 8 aa, Artificial Sequence
  source: /note="Description of Artificial Sequence: Synthetic peptide"
YGNYWFAY

SEQ ID NO: 930 - protein, 15 aa, Artificial Sequence
  source: /note="Description of Artificial Sequence: Synthetic peptide"
KASQSVDFDGDSYMN

SEQ ID NO: 931 - protein, 7 aa, Artificial Sequence
  source: /note="Description of Artificial Sequence: Synthetic peptide"
AASNLES

SEQ ID NO: 932 - protein, 9 aa, Artificial Sequence
  source: /note="Description of Artificial Sequence: Synthetic peptide"
QQSNEDPWT

SEQ ID NO: 933 - protein, 9 aa, Artificial Sequence
  source: /note="Description of Artificial Sequence: Synthetic peptide"
YTFTTYWMH

SEQ ID NO: 934 - protein, 14 aa, Artificial Sequence
  source: /note="Description of Artificial Sequence: Synthetic peptide"
WIGYINPSTGYTDY

SEQ ID NO: 935 - protein, 16 aa, Artificial Sequence
  source: /note="Description of Artificial Sequence: Synthetic peptide"
TRRGPSYGNHGAWFPY

SEQ ID NO: 936 - protein, 8 aa, Artificial Sequence
  source: /note="Description of Artificial Sequence: Synthetic peptide"
ENVDTYVS

SEQ ID NO: 937 - protein, 11 aa, Artificial Sequence
  source: /note="Description of Artificial Sequence: Synthetic peptide"
LLIYGASNRYT

SEQ ID NO: 938 - protein, 8 aa, Artificial Sequence
  source: /note="Description of Artificial Sequence: Synthetic peptide"
GQSYRYPP

SEQ ID NO: 939 - protein, 10 aa, Artificial Sequence
  source: /note="Description of Artificial Sequence: Synthetic peptide"
GYTFTGYYMH

SEQ ID NO: 940 - protein, 15 aa, Artificial Sequence
  source: /note="Description of Artificial Sequence: Synthetic peptide"
WIDPNSGATTYAQKF

SEQ ID NO: 941 - protein, 11 aa, Artificial Sequence
  source: /note="Description of Artificial Sequence: Synthetic peptide"
KTTQTTWGFPF

SEQ ID NO: 942 - protein, 11 aa, Artificial Sequence
  source: /note="Description of Artificial Sequence: Synthetic peptide"
RASQGVYQWLA

SEQ ID NO: 943 - protein, 7 aa, Artificial Sequence
  source: /note="Description of Artificial Sequence: Synthetic peptide"
KASHLYN

SEQ ID NO: 944 - protein, 9 aa, Artificial Sequence
  source: /note="Description of Artificial Sequence: Synthetic peptide"
QQLNSYPLT

SEQ ID NO: 945 - protein, 10 aa, Artificial Sequence
  source: /note="Description of Artificial Sequence: Synthetic peptide"
GYTFTDYWMH

SEQ ID NO: 946 - protein, 14 aa, Artificial Sequence
  source: /note="Description of Artificial Sequence: Synthetic peptide"
WIGYINPNTAYTDY

SEQ ID NO: 947 - protein, 11 aa, Artificial Sequence
  source: /note="Description of Artificial Sequence: Synthetic peptide"
KASENVDSFVS

SEQ ID NO: 948 - protein, 7 aa, Artificial Sequence
  source: /note="Description of Artificial Sequence: Synthetic peptide"
GASNRYT

SEQ ID NO: 949 - protein, 9 aa, Artificial Sequence
  source: /note="Description of Artificial Sequence: Synthetic peptide"
GQNYRYPLT

SEQ ID NO: 950 - protein, 9 aa, Artificial Sequence
  source: /note="Description of Artificial Sequence: Synthetic peptide"
FSLISYGVH

SEQ ID NO: 951 - protein, 13 aa, Artificial Sequence
  source: /note="Description of Artificial Sequence: Synthetic peptide"
WLGVIWRGGSTDY

SEQ ID NO: 952 - protein, 12 aa, Artificial Sequence
  source: /note="Description of Artificial Sequence: Synthetic peptide"
KTLITTGYAMDY

SEQ ID NO: 953 - protein, 8 aa, Artificial Sequence
  source: /note="Description of Artificial Sequence: Synthetic peptide"
EDIYNRLA

SEQ ID NO: 954 - protein, 12 aa, Artificial Sequence
  source: /note="Description of Artificial Sequence: Synthetic peptide"
LLISGATSLETG

SEQ ID NO: 955 - protein, 7 aa, Artificial Sequence
  source: /note="Description of Artificial Sequence: Synthetic peptide"
QQYWSTP

SEQ ID NO: 956 - protein, 9 aa, Artificial Sequence
  source: /note="Description of Artificial Sequence: Synthetic peptide"
FTFNSFAMS

SEQ ID NO: 957 - protein, 14 aa, Artificial Sequence
  source: /note="Description of Artificial Sequence: Synthetic peptide"
WVSAISGSGGGTYY

SEQ ID NO: 958 - protein, 14 aa, Artificial Sequence
  source: /note="Description of Artificial Sequence: Synthetic peptide"
KDKILWFGEPVFDY

SEQ ID NO: 959 - protein, 8 aa, Artificial Sequence
  source: /note="Description of Artificial Sequence: Synthetic peptide"
QSVSSYLA

SEQ ID NO: 960 - protein, 11 aa, Artificial Sequence
  source: /note="Description of Artificial Sequence: Synthetic peptide"
LLIYDASNRAT

SEQ ID NO: 961 - protein, 8 aa, Artificial Sequence
  source: /note="Description of Artificial Sequence: Synthetic peptide"
QQRSNWPP

SEQ ID NO: 962 - protein, 9 aa, Artificial Sequence
  source: /note="Description of Artificial Sequence: Synthetic peptide"
FSLTSYGVH

SEQ ID NO: 963 - protein, 13 aa, Artificial Sequence
  source: /note="Description of Artificial Sequence: Synthetic peptide"
WIGVMWRGGSTDY

SEQ ID NO: 964 - protein, 12 aa, Artificial Sequence
  source: /note="Description of Artificial Sequence: Synthetic peptide"
KSMITTGFVMDS

SEQ ID NO: 965 - protein, 8 aa, Artificial Sequence
  source: /note="Description of Artificial Sequence: Synthetic peptide"
EDIYNRLT

SEQ ID NO: 966 - protein, 11 aa, Artificial Sequence
  source: /note="Description of Artificial Sequence: Synthetic peptide"
LLISGATSLET

SEQ ID NO: 967 - protein, 8 aa, Artificial Sequence
  source: /note="Description of Artificial Sequence: Synthetic peptide"
QQYWSNPY

SEQ ID NO: 968 - protein, 9 aa, Artificial Sequence
  source: /note="Description of Artificial Sequence: Synthetic peptide"
FDFSRSWMN

SEQ ID NO: 969 - protein, 14 aa, Artificial Sequence
  source: /note="Description of Artificial Sequence: Synthetic peptide"
WIGEINPDSSTINY

SEQ ID NO: 970 - protein, 8 aa, Artificial Sequence
  source: /note="Description of Artificial Sequence: Synthetic peptide"
RYGNWFPY

SEQ ID NO: 971 - protein, 8 aa, Artificial Sequence
  source: /note="Description of Artificial Sequence: Synthetic peptide"
QNVDTNVA

SEQ ID NO: 972 - protein, 11 aa, Artificial Sequence
  source: /note="Description of Artificial Sequence: Synthetic peptide"
ALIYSASYRYS

SEQ ID NO: 973 - protein, 8 aa, Artificial Sequence
  source: /note="Description of Artificial Sequence: Synthetic peptide"
QQYDSYPL

SEQ ID NO: 974 - protein, 9 aa, Artificial Sequence
  source: /note="Description of Artificial Sequence: Synthetic peptide"
GTFSSYAFS

SEQ ID NO: 975 - protein, 14 aa, Artificial Sequence
  source: /note="Description of Artificial Sequence: Synthetic peptide"
WMGRVIPFLGIANS

SEQ ID NO: 976 - protein, 12 aa, Artificial Sequence
  source: /note="Description of Artificial Sequence: Synthetic peptide"
RDDIAALGPFDY

SEQ ID NO: 977 - protein, 8 aa, Artificial Sequence
  source: /note="Description of Artificial Sequence: Synthetic peptide"
QGISSWLA

SEQ ID NO: 978 - protein, 11 aa, Artificial Sequence
  source: /note="Description of Artificial Sequence: Synthetic peptide"
SLIYAASSLQS

SEQ ID NO: 979 - protein, 8 aa, Artificial Sequence
  source: /note="Description of Artificial Sequence: Synthetic peptide"
QQYNSYPR

SEQ ID NO: 980 - protein, 9 aa, Artificial Sequence
  source: /note="Description of Artificial Sequence: Synthetic peptide"
YTFTDYWMQ

SEQ ID NO: 981 - protein, 14 aa, Artificial Sequence
  source: /note="Description of Artificial Sequence: Synthetic peptide"
WIGTIYPGDGDTGY

SEQ ID NO: 982 - protein, 12 aa, Artificial Sequence
  source: /note="Description of Artificial Sequence: Synthetic peptide"
RGDYYGSNSLDY

SEQ ID NO: 983 - protein, 8 aa, Artificial Sequence
  source: /note="Description of Artificial Sequence: Synthetic peptide"
QDVSTVVA

SEQ ID NO: 984 - protein, 11 aa, Artificial Sequence
  source: /note="Description of Artificial Sequence: Synthetic peptide"
RLIYSASYRYI

SEQ ID NO: 985 - protein, 8 aa, Artificial Sequence
  source: /note="Description of Artificial Sequence: Synthetic peptide"
QQHYSPPY

SEQ ID NO: 986 - protein, 10 aa, Artificial Sequence
  source: /note="Description of Artificial Sequence: Synthetic peptide"
GFSLTSYGVH

SEQ ID NO: 987 - protein, 16 aa, Artificial Sequence
  source: /note="Description of Artificial Sequence: Synthetic peptide"
VMWRGGSTDYNAAFMS

SEQ ID NO: 988 - protein, 11 aa, Artificial Sequence
  source: /note="Description of Artificial Sequence: Synthetic peptide"
SMITTGFVMDS

SEQ ID NO: 989 - protein, 11 aa, Artificial Sequence
  source: /note="Description of Artificial Sequence: Synthetic peptide"
KASEDIYNRLT

SEQ ID NO: 990 - protein, 7 aa, Artificial Sequence
  source: /note="Description of Artificial Sequence: Synthetic peptide"
GATSLET

SEQ ID NO: 991 - protein, 9 aa, Artificial Sequence
  source: /note="Description of Artificial Sequence: Synthetic peptide"
QQYWSNPYT

SEQ ID NO: 992 - protein, 10 aa, Artificial Sequence
  source: /note="Description of Artificial Sequence: Synthetic peptide"
GFSLISYGVH

SEQ ID NO: 993 - protein, 16 aa, Artificial Sequence
  source: /note="Description of Artificial Sequence: Synthetic peptide"
VIWRGGSTDYNAAFMS

SEQ ID NO: 994 - protein, 11 aa, Artificial Sequence
  source: /note="Description of Artificial Sequence: Synthetic peptide"
TLITTGYAMDY

SEQ ID NO: 995 - protein, 11 aa, Artificial Sequence
  source: /note="Description of Artificial Sequence: Synthetic peptide"
KASEDIYNRLA

SEQ ID NO: 996 - protein, 7 aa, Artificial Sequence
  source: /note="Description of Artificial Sequence: Synthetic peptide"
GATSLET

SEQ ID NO: 997 - protein, 8 aa, Artificial Sequence
  source: /note="Description of Artificial Sequence: Synthetic peptide"
QQYWSTPT

SEQ ID NO: 998 - protein, 10 aa, Artificial Sequence
  source: /note="Description of Artificial Sequence: Synthetic peptide"
GFDFSRSWMN

SEQ ID NO: 999 - protein, 17 aa, Artificial Sequence
  source: /note="Description of Artificial Sequence: Synthetic peptide"
EINPDSSTINYTTSLKD

SEQ ID NO: 1000 - protein, 7 aa, Artificial Sequence
  source: /note="Description of Artificial Sequence: Synthetic peptide"
YGNWFPY

SEQ ID NO: 1001 - protein, 11 aa, Artificial Sequence
  source: /note="Description of Artificial Sequence: Synthetic peptide"
KASQNVDTNVA

SEQ ID NO: 1002 - protein, 7 aa, Artificial Sequence
  source: /note="Description of Artificial Sequence: Synthetic peptide"
SASYRYS

SEQ ID NO: 1003 - protein, 9 aa, Artificial Sequence
  source: /note="Description of Artificial Sequence: Synthetic peptide"
QQYDSYPLT

SEQ ID NO: 1004 - protein, 9 aa, Artificial Sequence
  source: /note="Description of Artificial Sequence: Synthetic peptide"
FDFSRYWMS

SEQ ID NO: 1005 - protein, 14 aa, Artificial Sequence
  source: /note="Description of Artificial Sequence: Synthetic peptide"
WIGEINPTSSTINF

SEQ ID NO: 1006 - protein, 13 aa, Artificial Sequence
  source: /note="Description of Artificial Sequence: Synthetic peptide"
RGNYYRYGDAMDY

SEQ ID NO: 1007 - protein, 12 aa, Artificial Sequence
  source: /note="Description of Artificial Sequence: Synthetic peptide"
KSVSTSGYSYLH

SEQ ID NO: 1008 - protein, 11 aa, Artificial Sequence
  source: /note="Description of Artificial Sequence: Synthetic peptide"
LLIYLASNLES

SEQ ID NO: 1009 - protein, 8 aa, Artificial Sequence
  source: /note="Description of Artificial Sequence: Synthetic peptide"
QHSRELPF

SEQ ID NO: 1010 - protein, 9 aa, Artificial Sequence
  source: /note="Description of Artificial Sequence: Synthetic peptide"
STFTTYWIH

SEQ ID NO: 1011 - protein, 14 aa, Artificial Sequence
  source: /note="Description of Artificial Sequence: Synthetic peptide"
WIGYINPNTGYTEY

SEQ ID NO: 1012 - protein, 9 aa, Artificial Sequence
  source: /note="Description of Artificial Sequence: Synthetic peptide"
VRFITVVGG

SEQ ID NO: 1013 - protein, 9 aa, Artificial Sequence
  source: /note="Description of Artificial Sequence: Synthetic peptide"
SSVSSSHLH

SEQ ID NO: 1014 - protein, 11 aa, Artificial Sequence
  source: /note="Description of Artificial Sequence: Synthetic peptide"
LWIYSTSNLAS

SEQ ID NO: 1015 - protein, 8 aa, Artificial Sequence
  source: /note="Description of Artificial Sequence: Synthetic peptide"
HQYHRSPL

SEQ ID NO: 1016 - protein, 11 aa, Artificial Sequence
  source: /note="Description of Artificial Sequence: Synthetic peptide"
FSLTTYGIGVG

SEQ ID NO: 1017 - protein, 13 aa, Artificial Sequence
  source: /note="Description of Artificial Sequence: Synthetic peptide"
WLTHIWWNDNKYY

SEQ ID NO: 1018 - protein, 5 aa, Artificial Sequence
  source: /note="Description of Artificial Sequence: Synthetic peptide"
YGYTY

SEQ ID NO: 1019 - protein, 13 aa, Artificial Sequence
  source: /note="Description of Artificial Sequence: Synthetic peptide"
QSLLYSNGNTYLH

SEQ ID NO: 1020 - protein, 11 aa, Artificial Sequence
  source: /note="Description of Artificial Sequence: Synthetic peptide"
LLIYKLSNRFS

SEQ ID NO: 1021 - protein, 8 aa, Artificial Sequence
  source: /note="Description of Artificial Sequence: Synthetic peptide"
SQSTHVPW

SEQ ID NO: 1022 - protein, 9 aa, Artificial Sequence
  source: /note="Description of Artificial Sequence: Synthetic peptide"
FNIKDTYIH

SEQ ID NO: 1023 - protein, 14 aa, Artificial Sequence
  source: /note="Description of Artificial Sequence: Synthetic peptide"
WVARIYPTNGYTRY

SEQ ID NO: 1024 - protein, 12 aa, Artificial Sequence
  source: /note="Description of Artificial Sequence: Synthetic peptide"
RWGGDGFYAMDY

SEQ ID NO: 1025 - protein, 8 aa, Artificial Sequence
  source: /note="Description of Artificial Sequence: Synthetic peptide"
QDVNTAVA

SEQ ID NO: 1026 - protein, 11 aa, Artificial Sequence
  source: /note="Description of Artificial Sequence: Synthetic peptide"
LLIYSASFLYS

SEQ ID NO: 1027 - protein, 8 aa, Artificial Sequence
  source: /note="Description of Artificial Sequence: Synthetic peptide"
QQHYTTPP

SEQ ID NO: 1028 - protein, 12 aa, Artificial Sequence
  source: /note="Description of Artificial Sequence: Synthetic peptide"
RWGGDGFYAMDV

SEQ ID NO: 1029 - protein, 9 aa, Artificial Sequence
  source: /note="Description of Artificial Sequence: Synthetic peptide"
YSFTSYWIA

SEQ ID NO: 1030 - protein, 14 aa, Artificial Sequence
  source: /note="Description of Artificial Sequence: Synthetic peptide"
YMGLIYPGDSDTKY

SEQ ID NO: 1031 - protein, 21 aa, Artificial Sequence
  source: /note="Description of Artificial Sequence: Synthetic peptide"
RHDVGYCSSSNCAKWPEYFQH

SEQ ID NO: 1032 - protein, 10 aa, Artificial Sequence
  source: /note="Description of Artificial Sequence: Synthetic peptide"
SSNIGNNYVS

SEQ ID NO: 1033 - protein, 11 aa, Artificial Sequence
  source: /note="Description of Artificial Sequence: Synthetic peptide"
LLIYGHTNRPA

SEQ ID NO: 1034 - protein, 10 aa, Artificial Sequence
  source: /note="Description of Artificial Sequence: Synthetic peptide"
AAWDDSLSGW

SEQ ID NO: 1035 - protein, 9 aa, Artificial Sequence
  source: /note="Description of Artificial Sequence: Synthetic peptide"
YPFTNYGMN

SEQ ID NO: 1036 - protein, 14 aa, Artificial Sequence
  source: /note="Description of Artificial Sequence: Synthetic peptide"
WMGWINTSTGESTF

SEQ ID NO: 1037 - protein, 11 aa, Artificial Sequence
  source: /note="Description of Artificial Sequence: Synthetic peptide"
RWEVYHGYVPY

SEQ ID NO: 1038 - protein, 8 aa, Artificial Sequence
  source: /note="Description of Artificial Sequence: Synthetic peptide"
QDVYNAVA

SEQ ID NO: 1039 - protein, 11 aa, Artificial Sequence
  source: /note="Description of Artificial Sequence: Synthetic peptide"
LLIYSASSRYT

SEQ ID NO: 1040 - protein, 8 aa, Artificial Sequence
  source: /note="Description of Artificial Sequence: Synthetic peptide"
QQHFRTPF

SEQ ID NO: 1041 - protein, 9 aa, Artificial Sequence
  source: /note="Description of Artificial Sequence: Synthetic peptide"
ITFSINTMG

SEQ ID NO: 1042 - protein, 14 aa, Artificial Sequence
  source: /note="Description of Artificial Sequence: Synthetic peptide"
LVALISSIGDTYYA

SEQ ID NO: 1043 - protein, 12 aa, Artificial Sequence
  source: /note="Description of Artificial Sequence: Synthetic peptide"
KRFRTAAQGTDY

SEQ ID NO: 1044 - protein, 10 aa, Artificial Sequence
  source: /note="Description of Artificial Sequence: Synthetic peptide"
GFNIKDTYIH

SEQ ID NO: 1045 - protein, 17 aa, Artificial Sequence
  source: /note="Description of Artificial Sequence: Synthetic peptide"
RIYPTNGYTRYADSVKG

SEQ ID NO: 1046 - protein, 11 aa, Artificial Sequence
  source: /note="Description of Artificial Sequence: Synthetic peptide"
WGGDGFYAMDY

SEQ ID NO: 1047 - protein, 11 aa, Artificial Sequence
  source: /note="Description of Artificial Sequence: Synthetic peptide"
RASQDVNTAVA

SEQ ID NO: 1048 - protein, 7 aa, Artificial Sequence
  source: /note="Description of Artificial Sequence: Synthetic peptide"
SASFLYS

SEQ ID NO: 1049 - protein, 9 aa, Artificial Sequence
  source: /note="Description of Artificial Sequence: Synthetic peptide"
QQHYTTPPT

SEQ ID NO: 1050 - protein, 10 aa, Artificial Sequence
  source: /note="Description of Artificial Sequence: Synthetic peptide"
GFNIKDTYIH

SEQ ID NO: 1051 - protein, 17 aa, Artificial Sequence
  source: /note="Description of Artificial Sequence: Synthetic peptide"
RIYPTNGYTRYADSVKG

SEQ ID NO: 1052 - protein, 11 aa, Artificial Sequence
  source: /note="Description of Artificial Sequence: Synthetic peptide"
WGGDGFYAMDV

SEQ ID NO: 1053 - protein, 11 aa, Artificial Sequence
  source: /note="Description of Artificial Sequence: Synthetic peptide"
RASQDVNTAVA

SEQ ID NO: 1054 - protein, 7 aa, Artificial Sequence
  source: /note="Description of Artificial Sequence: Synthetic peptide"
SASFLYS

SEQ ID NO: 1055 - protein, 9 aa, Artificial Sequence
  source: /note="Description of Artificial Sequence: Synthetic peptide"
QQHYTTPPT

SEQ ID NO: 1056 - protein, 10 aa, Artificial Sequence
  source: /note="Description of Artificial Sequence: Synthetic peptide"
GYSFTSYWIA

SEQ ID NO: 1057 - protein, 17 aa, Artificial Sequence
  source: /note="Description of Artificial Sequence: Synthetic peptide"
LIYPGDSDTKYSPSFQG

SEQ ID NO: 1058 - protein, 20 aa, Artificial Sequence
  source: /note="Description of Artificial Sequence: Synthetic peptide"
HDVGYCSSSNCAKWPEYFQH

SEQ ID NO: 1059 - protein, 13 aa, Artificial Sequence
  source: /note="Description of Artificial Sequence: Synthetic peptide"
SGSSSNIGNNYVS

SEQ ID NO: 1060 - protein, 7 aa, Artificial Sequence
  source: /note="Description of Artificial Sequence: Synthetic peptide"
GHTNRPA

SEQ ID NO: 1061 - protein, 11 aa, Artificial Sequence
  source: /note="Description of Artificial Sequence: Synthetic peptide"
AAWDDSLSGWV

SEQ ID NO: 1062 - protein, 10 aa, Artificial Sequence
  source: /note="Description of Artificial Sequence: Synthetic peptide"
GITFSINTMG

SEQ ID NO: 1063 - protein, 16 aa, Artificial Sequence
  source: /note="Description of Artificial Sequence: Synthetic peptide"
LISSIGDTYYADSVKG

SEQ ID NO: 1064 - protein, 10 aa, Artificial Sequence
  source: /note="Description of Artificial Sequence: Synthetic peptide"
FRTAAQGTDY

SEQ ID NO: 1065 - protein, 9 aa, Artificial Sequence
  source: /note="Description of Artificial Sequence: Synthetic peptide"
FTFSDSWIH

SEQ ID NO: 1066 - protein, 14 aa, Artificial Sequence
  source: /note="Description of Artificial Sequence: Synthetic peptide"
WVAWISPYGGSTYY

SEQ ID NO: 1067 - protein, 10 aa, Artificial Sequence
  source: /note="Description of Artificial Sequence: Synthetic peptide"
RRHWPGGFDY

SEQ ID NO: 1068 - protein, 8 aa, Artificial Sequence
  source: /note="Description of Artificial Sequence: Synthetic peptide"
QDVSTAVA

SEQ ID NO: 1069 - protein, 11 aa, Artificial Sequence
  source: /note="Description of Artificial Sequence: Synthetic peptide"
LLIYSASFLYS

SEQ ID NO: 1070 - protein, 8 aa, Artificial Sequence
  source: /note="Description of Artificial Sequence: Synthetic peptide"
QQYLYHPA

SEQ ID NO: 1071 - protein, 9 aa, Artificial Sequence
  source: /note="Description of Artificial Sequence: Synthetic peptide"
YTFTSYVMH

SEQ ID NO: 1072 - protein, 14 aa, Artificial Sequence
  source: /note="Description of Artificial Sequence: Synthetic peptide"
WIGYVNPFNDGTKY

SEQ ID NO: 1073 - protein, 7 aa, Artificial Sequence
  source: /note="Description of Artificial Sequence: Synthetic peptide"
RQAWGYP

SEQ ID NO: 1074 - protein, 12 aa, Artificial Sequence
  source: /note="Description of Artificial Sequence: Synthetic peptide"
ESVEYYGTSLVQ

SEQ ID NO: 1075 - protein, 11 aa, Artificial Sequence
  source: /note="Description of Artificial Sequence: Synthetic peptide"
LLIYAASSVDS

SEQ ID NO: 1076 - protein, 8 aa, Artificial Sequence
  source: /note="Description of Artificial Sequence: Synthetic peptide"
QQSRRVPY

SEQ ID NO: 1077 - protein, 9 aa, Artificial Sequence
  source: /note="Description of Artificial Sequence: Synthetic peptide"
YTFTSYDVH

SEQ ID NO: 1078 - protein, 14 aa, Artificial Sequence
  source: /note="Description of Artificial Sequence: Synthetic peptide"
WMGWLHADTGITKF

SEQ ID NO: 1079 - protein, 10 aa, Artificial Sequence
  source: /note="Description of Artificial Sequence: Synthetic peptide"
RERIQLWFDY

SEQ ID NO: 1080 - protein, 8 aa, Artificial Sequence
  source: /note="Description of Artificial Sequence: Synthetic peptide"
QGISSWLA

SEQ ID NO: 1081 - protein, 11 aa, Artificial Sequence
  source: /note="Description of Artificial Sequence: Synthetic peptide"
SLIYAASSLQS

SEQ ID NO: 1082 - protein, 8 aa, Artificial Sequence
  source: /note="Description of Artificial Sequence: Synthetic peptide"
QQYNSYPY

SEQ ID NO: 1083 - protein, 9 aa, Artificial Sequence
  source: /note="Description of Artificial Sequence: Synthetic peptide"
DTFSTYAIS

SEQ ID NO: 1084 - protein, 14 aa, Artificial Sequence
  source: /note="Description of Artificial Sequence: Synthetic peptide"
WMGGIIPIFGKAHY

SEQ ID NO: 1085 - protein, 15 aa, Artificial Sequence
  source: /note="Description of Artificial Sequence: Synthetic peptide"
RKFHFVSGSPFGMDV

SEQ ID NO: 1086 - protein, 8 aa, Artificial Sequence
  source: /note="Description of Artificial Sequence: Synthetic peptide"
QSVSSYLA

SEQ ID NO: 1087 - protein, 11 aa, Artificial Sequence
  source: /note="Description of Artificial Sequence: Synthetic peptide"
LLIYDASNRAT

SEQ ID NO: 1088 - protein, 7 aa, Artificial Sequence
  source: /note="Description of Artificial Sequence: Synthetic peptide"
QQRSNWP

SEQ ID NO: 1089 - protein, 9 aa, Artificial Sequence
  source: /note="Description of Artificial Sequence: Synthetic peptide"
FTFSSYIMM

SEQ ID NO: 1090 - protein, 14 aa, Artificial Sequence
  source: /note="Description of Artificial Sequence: Synthetic peptide"
WVSSIYPSGGITFY

SEQ ID NO: 1091 - protein, 12 aa, Artificial Sequence
  source: /note="Description of Artificial Sequence: Synthetic peptide"
RIKLGTVTTVDY

SEQ ID NO: 1092 - protein, 11 aa, Artificial Sequence
  source: /note="Description of Artificial Sequence: Synthetic peptide"
SSDVGGYNYVS

SEQ ID NO: 1093 - protein, 11 aa, Artificial Sequence
  source: /note="Description of Artificial Sequence: Synthetic peptide"
LMIYDVSNRPS

SEQ ID NO: 1094 - protein, 9 aa, Artificial Sequence
  source: /note="Description of Artificial Sequence: Synthetic peptide"
SSYTSSSTR

SEQ ID NO: 1095 - protein, 10 aa, Artificial Sequence
  source: /note="Description of Artificial Sequence: Synthetic peptide"
GFNIKDYFLH

SEQ ID NO: 1096 - protein, 17 aa, Artificial Sequence
  source: /note="Description of Artificial Sequence: Synthetic peptide"
WINPDNGNTVYDPKFQG

SEQ ID NO: 1097 - protein, 12 aa, Artificial Sequence
  source: /note="Description of Artificial Sequence: Synthetic peptide"
RDYTYEKAALDY

SEQ ID NO: 1098 - protein, 11 aa, Artificial Sequence
  source: /note="Description of Artificial Sequence: Synthetic peptide"
RASGNIYNYLA

SEQ ID NO: 1099 - protein, 7 aa, Artificial Sequence
  source: /note="Description of Artificial Sequence: Synthetic peptide"
DAKTLAD

SEQ ID NO: 1100 - protein, 9 aa, Artificial Sequence
  source: /note="Description of Artificial Sequence: Synthetic peptide"
QHFWSLPFT

SEQ ID NO: 1101 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 1102 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGCGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 1103 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHCGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAA

SEQ ID NO: 1104 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLCGASYVMTAEDVDLTLNWGRLSSVLPDYHGQDSVRVGRISFGSINAILGSVALILNSHHHASAVAA

SEQ ID NO: 1105 - protein, 499 aa, Artificial Sequence; identical to SEQ ID NO: 838
  source: /note="Description of Artificial Sequence: Synthetic polypeptide"

SEQ ID NO: 1106 - protein, 499 aa, Artificial Sequence; identical to SEQ ID NO: 843
  source: /note="Description of Artificial Sequence: Synthetic polypeptide"

SEQ ID NO: 1107 - protein, 519 aa, Artificial Sequence; identical to SEQ ID NO: 842
  source: /note="Description of Artificial Sequence: Synthetic polypeptide"

SEQ ID NO: 1108 - protein, 519 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSGGGGSGGGGSGGGGSGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 1109 - protein, 293 aa, Artificial Sequence
  source: /note="Description of Artificial Sequence: Synthetic polypeptide"
KEFTLDFSTAATYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNAILWDSSTLGAILMRRTISS

SEQ ID NO: 1110 - protein, 293 aa, Artificial Sequence
  source: /note="Description of Artificial Sequence: Synthetic polypeptide"
AEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNAILWDSSTLGAILMRRTISS

SEQ ID NO: 1111 - protein, 293 aa, Artificial Sequence
  source: /note="Description of Artificial Sequence: Synthetic polypeptide"
AEFTLDFSTAATYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 1112 - protein, 251 aa, Artificial Sequence
  source: /note="Description of Artificial Sequence: Synthetic polypeptide"
KEFTLDFSTAATYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 1113 - protein, 283 aa, Artificial Sequence
  source: /note="Description of Artificial Sequence: Synthetic polypeptide"
KTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNAILWDSSTLGAILMRRTISS

SEQ ID NO: 1114 - protein, 241 aa, Artificial Sequence
  source: /note="Description of Artificial Sequence: Synthetic polypeptide"
KTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 1115 - protein, 292 aa, Artificial Sequence
  source: /note="Description of Artificial Sequence: Synthetic polypeptide"
EFTLDFSTAATYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 1116 - protein, 282 aa, Artificial Sequence
  source: /note="Description of Artificial Sequence: Synthetic polypeptide"
TYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 1117 - protein, 293 aa, Artificial Sequence
  source: /note="Description of Artificial Sequence: Synthetic polypeptide"
KEFTLDFSTAATYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNAILWDSSTLGAILMRRTISS

SEQ ID NO: 1118 - protein, 293 aa, Artificial Sequence
  source: /note="Description of Artificial Sequence: Synthetic polypeptide"
AEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNAILWDSSTLGAILMRRTISS

SEQ ID NO: 1119 - protein, 293 aa, Artificial Sequence
  source: /note="Description of Artificial Sequence: Synthetic polypeptide"
AEFTLDFSTAATYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 1120 - protein, 251 aa, Artificial Sequence
  source: /note="Description of Artificial Sequence: Synthetic polypeptide"
KEFTLDFSTAATYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 1121 - protein, 283 aa, Artificial Sequence
  source: /note="Description of Artificial Sequence: Synthetic polypeptide"
KTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNAILWDSSTLGAILMRRTISS

SEQ ID NO: 1122 - protein, 241 aa, Artificial Sequence
  source: /note="Description of Artificial Sequence: Synthetic polypeptide"
KTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 1123 - protein, 292 aa, Artificial Sequence
  source: /note="Description of Artificial Sequence: Synthetic polypeptide"
EFTLDFSTAATYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 1124 - protein, 282 aa, Artificial Sequence
  source: /note="Description of Artificial Sequence: Synthetic polypeptide"
TYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 1125 - protein, 297 aa, Artificial Sequence
  source: /note="Description of Artificial Sequence: Synthetic polypeptide"
DEFTVDFSSQKSYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQATECQIVGDRAAIAVNNVLWEANTIAALLNRAPQDLTEPNQ

SEQ ID NO: 1126 - protein, 297 aa, Artificial Sequence
  source: /note="Description of Artificial Sequence: Synthetic polypeptide"
DEFTVDFSSQASYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQKQATECQIVGDRAAIAVNNVLWEANTIAALLNRAPQDLTEPNQ

SEQ ID NO: 1127 - protein, 297 aa, Artificial Sequence
  source: /note="Description of Artificial Sequence: Synthetic polypeptide"
DEFTVDFSSQASYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQKTECQIVGDRAAIAVNNVLWEANTIAALLNRAPQDLTEPNQ

SEQ ID NO: 1128 - protein, 297 aa, Artificial Sequence
  source: /note="Description of Artificial Sequence: Synthetic polypeptide"
DEFTVDFSSQASYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQATECQIVGDRAAIKVNNVLWEANTIAALLNRAPQDLTEPNQ

SEQ ID NO: 1129 - protein, 297 aa, Artificial Sequence
  source: /note="Description of Artificial Sequence: Synthetic polypeptide"
DEFTVDFSSQASYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQATECQIVGDRAAIAVNNVLWEANTIAALLNRKPQDLTEPNQ

SEQ ID NO: 1130 - protein, 250 aa, Artificial Sequence
  source: /note="Description of Artificial Sequence: Synthetic polypeptide"
DEFTVDFSSQKSYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVR

SEQ ID NO: 1131 - protein, 286 aa, Artificial Sequence
  source: /note="Description of Artificial Sequence: Synthetic polypeptide"
SYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQKQATECQIVGDRAAIAVNNVLWEANTIAALLNRAPQDLTEPNQ

SEQ ID NO: 1132 - protein, 286 aa, Artificial Sequence
  source: /note="Description of Artificial Sequence: Synthetic polypeptide"
SYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQKTECQIVGDRAAIAVNNVLWEANTIAALLNRAPQDLTEPNQ

SEQ ID NO: 1133 - protein, 286 aa, Artificial Sequence
  source: /note="Description of Artificial Sequence: Synthetic polypeptide"
SYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQATECQIVGDRAAIKVNNVLWEANTIAALLNRAPQDLTEPNQ

SEQ ID NO: 1134 - protein, 286 aa, Artificial Sequence
  source: /note="Description of Artificial Sequence: Synthetic polypeptide"
SYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQATECQIVGDRAAIAVNNVLWEANTIAALLNRKPQDLTEPNQ

SEQ ID NO: 1135 - protein, 255 aa, Artificial Sequence
  source: /note="Description of Artificial Sequence: Synthetic polypeptide"
DEFTVDFSSQASYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQK

SEQ ID NO: 1136 - protein, 257 aa, Artificial Sequence
  source: /note="Description of Artificial Sequence: Synthetic polypeptide"
DEFTVDFSSQASYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQK

SEQ ID NO: 1137 - protein, 270 aa, Artificial Sequence
  source: /note="Description of Artificial Sequence: Synthetic polypeptide"
DEFTVDFSSQASYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQATECQIVGDRAAIK

SEQ ID NO: 1138 - protein, 244 aa, Artificial Sequence
  source: /note="Description of Artificial Sequence: Synthetic polypeptide"
SYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQK

SEQ ID NO: 1139 - protein, 246 aa, Artificial Sequence
  source: /note="Description of Artificial Sequence: Synthetic polypeptide"
SYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQK

SEQ ID NO: 1140 - protein, 259 aa, Artificial Sequence
  source: /note="Description of Artificial Sequence: Synthetic polypeptide"
SYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQAQATECQIVGDRAAIK

SEQ ID NO: 1141 - protein, 499 aa, Artificial Sequence
  source: /note="Description of Artificial Sequence: Synthetic polypeptide"
MKEFTLDFSTAKTYVDSLNVIRSAIGTPLQTISCGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTADALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 1142 - protein, 4 aa, Artificial Sequence
  source: /note="Description of Artificial Sequence: Synthetic peptide"
KDEL

SEQ ID NO: 1143 - protein, 4 aa, Artificial Sequence
  source: /note="Description of Artificial Sequence: Synthetic peptide"
HDEF

SEQ ID NO: 1144 - protein, 4 aa, Artificial Sequence
  source: /note="Description of Artificial Sequence: Synthetic peptide"
HDEL

SEQ ID NO: 1145 - protein, 4 aa, Artificial Sequence
  source: /note="Description of Artificial Sequence: Synthetic peptide"
RDEF

SEQ ID NO: 1146 - protein, 4 aa, Artificial Sequence
  source: /note="Description of Artificial Sequence: Synthetic peptide"
RDEL

SEQ ID NO: 1147 - protein, 4 aa, Artificial Sequence
  source: /note="Description of Artificial Sequence: Synthetic peptide"
WDEL

SEQ ID NO: 1148 - protein, 4 aa, Artificial Sequence
  source: /note="Description of Artificial Sequence: Synthetic peptide"
YDEL

SEQ ID NO: 1149 - protein, 4 aa, Artificial Sequence
  source: /note="Description of Artificial Sequence: Synthetic peptide"
HEEF

SEQ ID NO: 1150 - protein, 4 aa, Artificial Sequence
  source: /note="Description of Artificial Sequence: Synthetic peptide"
HEEL

SEQ ID NO: 1151 - protein, 4 aa, Artificial Sequence
  source: /note="Description of Artificial Sequence: Synthetic peptide"
KEEL

SEQ ID NO: 1152 - protein, 4 aa, Artificial Sequence
  source: /note="Description of Artificial Sequence: Synthetic peptide"
REEL

SEQ ID NO: 1153 - protein, 4 aa, Artificial Sequence
  source: /note="Description of Artificial Sequence: Synthetic peptide"
KAEL

SEQ ID NO: 1154 - protein, 4 aa, Artificial Sequence
  source: /note="Description of Artificial Sequence: Synthetic peptide"
KCEL

SEQ ID NO: 1155 - protein, 4 aa, Artificial Sequence
  source: /note="Description of Artificial Sequence: Synthetic peptide"
KFEL

SEQ ID NO: 1156 - protein, 4 aa, Artificial Sequence
  source: /note="Description of Artificial Sequence: Synthetic peptide"
KGEL

SEQ ID NO: 1157 - protein, 4 aa, Artificial Sequence
  source: /note="Description of Artificial Sequence: Synthetic peptide"
KHEL

SEQ ID NO: 1158 - protein, 4 aa, Artificial Sequence
  source: /note="Description of Artificial Sequence: Synthetic peptide"
KLEL

SEQ ID NO: 1159 - protein, 4 aa, Artificial Sequence
  source: /note="Description of Artificial Sequence: Synthetic peptide"
KNEL

SEQ ID NO: 1160 - protein, 4 aa, Artificial Sequence
  source: /note="Description of Artificial Sequence: Synthetic peptide"
KQEL

SEQ ID NO: 1161 - protein, 4 aa, Artificial Sequence
  source: /note="Description of Artificial Sequence: Synthetic peptide"
KREL

SEQ ID NO: 1162 - protein, 4 aa, Artificial Sequence
  source: /note="Description of Artificial Sequence: Synthetic peptide"
KSEL

SEQ ID NO: 1163 - protein, 4 aa, Artificial Sequence
  source: /note="Description of Artificial Sequence: Synthetic peptide"
KVEL

SEQ ID NO: 1164 - protein, 4 aa, Artificial Sequence
  source: /note="Description of Artificial Sequence: Synthetic peptide"
KWEL

SEQ ID NO: 1165 - protein, 4 aa, Artificial Sequence
  source: /note="Description of Artificial Sequence: Synthetic peptide"
KYEL

SEQ ID NO: 1166 - protein, 4 aa, Artificial Sequence
  source: /note="Description of Artificial Sequence: Synthetic peptide"
KEDL

SEQ ID NO: 1167 - protein, 4 aa, Artificial Sequence
  source: /note="Description of Artificial Sequence: Synthetic peptide"
KIEL

SEQ ID NO: 1168 - protein, 4 aa, Artificial Sequence
  source: /note="Description of Artificial Sequence: Synthetic peptide"
DKEL

SEQ ID NO: 1169 - protein, 4 aa, Artificial Sequence
  source: /note="Description of Artificial Sequence: Synthetic peptide"
FDEL

SEQ ID NO: 1170 - protein, 4 aa, Artificial Sequence
  source: /note="Description of Artificial Sequence: Synthetic peptide"
KDEF

SEQ ID NO: 1171 - protein, 4 aa, Artificial Sequence
  source: /note="Description of Artificial Sequence: Synthetic peptide"
KKEL

SEQ ID NO: 1172 - protein, 4 aa, Artificial Sequence
  source: /note="Description of Artificial Sequence: Synthetic peptide"
HADL

SEQ ID NO: 1173 - protein, 4 aa, Artificial Sequence
  source: /note="Description of Artificial Sequence: Synthetic peptide"
HAEL

SEQ ID NO: 1174 - protein, 4 aa, Artificial Sequence
  source: /note="Description of Artificial Sequence: Synthetic peptide"
HIEL

SEQ ID NO: 1175 - protein, 4 aa, Artificial Sequence
  source: /note="Description of Artificial Sequence: Synthetic peptide"
HNEL

SEQ ID NO: 1176 - protein, 4 aa, Artificial Sequence
  source: /note="Description of Artificial Sequence: Synthetic peptide"
HTEL

SEQ ID NO: 1177 - protein, 4 aa, Artificial Sequence
  source: /note="Description of Artificial Sequence: Synthetic peptide"
KTEL

SEQ ID NO: 1178 - protein, 4 aa, Artificial Sequence
  source: /note="Description of Artificial Sequence: Synthetic peptide"
HVEL

SEQ ID NO: 1179 - protein, 4 aa, Artificial Sequence
  source: /note="Description of Artificial Sequence: Synthetic peptide"
NDEL

SEQ ID NO: 1180 - protein, 4 aa, Artificial Sequence
  source: /note="Description of Artificial Sequence: Synthetic peptide"
QDEL

SEQ ID NO: 1181 - protein, 4 aa, Artificial Sequence
  source: /note="Description of Artificial Sequence: Synthetic peptide"
REDL

SEQ ID NO: 1182 - protein, 4 aa, Artificial Sequence
  source: /note="Description of Artificial Sequence: Synthetic peptide"
RNEL

SEQ ID NO: 1183 - protein, 4 aa, Artificial Sequence
  source: /note="Description of Artificial Sequence: Synthetic peptide"
RTDL

SEQ ID NO: 1184 - protein, 4 aa, Artificial Sequence
  source: /note="Description of Artificial Sequence: Synthetic peptide"
RTEL

SEQ ID NO: 1185 - protein, 4 aa, Artificial Sequence
  source: /note="Description of Artificial Sequence: Synthetic peptide"
SDEL

SEQ ID NO: 1186 - protein, 4 aa, Artificial Sequence
  source: /note="Description of Artificial Sequence: Synthetic peptide"
TDEL

SEQ ID NO: 1187 - protein, 4 aa, Artificial Sequence
  source: /note="Description of Artificial Sequence: Synthetic peptide"
SKEL

SEQ ID NO: 1188 - protein, 4 aa, Artificial Sequence
  source: /note="Description of Artificial Sequence: Synthetic peptide"
STEL

SEQ ID NO: 1189 - protein, 4 aa, Artificial Sequence
  source: /note="Description of Artificial Sequence: Synthetic peptide"
EDEL

SEQ ID NO: 1190 - protein, 6 aa, Artificial Sequence
  source: /note="Description of Artificial Sequence: Synthetic peptide"
ASGGPE

SEQ ID NO: 1191 - protein, 54 aa, Artificial Sequence
  source: /note="Description of Artificial Sequence: Synthetic polypeptide"
  VARIANT (5)..(6): /replace=" "
  VARIANT (10)..(11): /replace=" "
  VARIANT (15)..(16): /replace=" "
  VARIANT (20)..(21): /replace=" "
  VARIANT (25)..(26): /replace=" "
  VARIANT (30)..(31): /replace=" "
  VARIANT (35)..(36): /replace=" "
  VARIANT (40)..(41): /replace=" "
  VARIANT (45)..(46): /replace=" "
  VARIANT (50)..(51): /replace=" "
  MISC_FEATURE (3)..(52): /note="This region may encompass 1-10 '(Gly)X-Ser' repeating units, wherein X represents 2-4"
  MISC_FEATURE (1)..(54): /note="Variant residues given in the sequence have no preference with respect to those in the annotations for variant positions"
AMGGGGSGGGGSGGGGSGGGGSGGGGSGGGGSGGGGSGGGGSGGGGSGGGGSAM

SEQ ID NO: 1192 - protein, 210 aa, Artificial Sequence
  source: /note="Description of Artificial Sequence: Synthetic polypeptide"
  VARIANT (2)..(6): /replace=" "
  VARIANT (9)..(13): /replace=" "
  VARIANT (16)..(20): /replace=" "
  VARIANT (23)..(27): /replace=" "
  VARIANT (30)..(34): /replace=" "
  VARIANT (37)..(41): /replace=" "
  VARIANT (44)..(48): /replace=" "
  VARIANT (51)..(55): /replace=" "
  VARIANT (58)..(62): /replace=" "
  VARIANT (65)..(69): /replace=" "
  VARIANT (72)..(76): /replace=" "
  VARIANT (79)..(83): /replace=" "
  VARIANT (86)..(90): /replace=" "
  VARIANT (93)..(97): /replace=" "
  VARIANT (100)..(104): /replace=" "
  VARIANT (107)..(111): /replace=" "
  VARIANT (114)..(118): /replace=" "
  VARIANT (121)..(125): /replace=" "
  VARIANT (128)..(132): /replace=" "
  VARIANT (135)..(139): /replace=" "
  VARIANT (142)..(146): /replace=" "
  VARIANT (149)..(153): /replace=" "
  VARIANT (156)..(160): /replace=" "
  VARIANT (163)..(167): /replace=" "
  VARIANT (170)..(174): /replace=" "
  VARIANT (177)..(181): /replace=" "
  VARIANT (184)..(188): /replace=" "
  VARIANT (191)..(195): /replace=" "
  VARIANT (198)..(202): /replace=" "
  VARIANT (205)..(209): /replace=" "
  MISC_FEATURE (1)..(210): /note="This sequence may encompass 1-30 '(Gly)X-Ser' repeating units, wherein X represents 1-6"
  MISC_FEATURE (1)..(210): /note="Variant residues given in the sequence have no preference with respect to those in the annotations for variant positions"
GGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGS

SEQ ID NO: 1193 - protein, 210 aa, Artificial Sequence
  source: /note="Description of Artificial Sequence: Synthetic polypeptide"
  VARIANT (2)..(6): /replace=" "
  VARIANT (9)..(13): /replace=" "
  VARIANT (16)..(20): /replace=" "
  VARIANT (23)..(27): /replace=" "
  VARIANT (30)..(34): /replace=" "
  VARIANT (37)..(41): /replace=" "
  VARIANT (44)..(48): /replace=" "
  VARIANT (51)..(55): /replace=" "
  VARIANT (58)..(62): /replace=" "
  VARIANT (65)..(69): /replace=" "
  VARIANT (72)..(76): /replace=" "
  VARIANT (79)..(83): /replace=" "
  VARIANT (86)..(90): /replace=" "
  VARIANT (93)..(97): /replace=" "
  VARIANT (100)..(104): /replace=" "
  VARIANT (107)..(111): /replace=" "
  VARIANT (114)..(118): /replace=" "
  VARIANT (121)..(125): /replace=" "
  VARIANT (128)..(132): /replace=" "
  VARIANT (135)..(139): /replace=" "
  VARIANT (142)..(146): /replace=" "
  VARIANT (149)..(153): /replace=" "
  VARIANT (156)..(160): /replace=" "
  VARIANT (163)..(167): /replace=" "
  VARIANT (170)..(174): /replace=" "
  VARIANT (177)..(181): /replace=" "
  VARIANT (184)..(188): /replace=" "
  VARIANT (191)..(195): /replace=" "
  VARIANT (198)..(202): /replace=" "
  VARIANT (205)..(209): /replace=" "
  MISC_FEATURE (1)..(210): /note="This sequence may encompass 1-30 '(Ser)X-Gly' repeating units, wherein X represents 1-6"
  MISC_FEATURE (1)..(210): /note="Variant residues given in the sequence have no preference with respect to those in the annotations for variant positions"
SSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSG

SEQ ID NO: 1194 - protein, 150 aa, Artificial Sequence
  source: /note="Description of Artificial Sequence: Synthetic polypeptide"
  MISC_FEATURE (1)..(150): /note="This sequence may encompass 1-30 'Gly-Gly-Gly- Gly-Ser' repeating units"
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 1195 - protein, 30 aa, Artificial Sequence
  source: /note="Description of Artificial Sequence: Synthetic polypeptide"
  VARIANT (2)..(30): /replace=" "
  MISC_FEATURE (1)..(30): /note="Variant residues given in the sequence have no preference with respect to those in the annotations for variant positions"
GGGGGGGGGGGGGGGGGGGGGGGGGGGGGG

SEQ ID NO: 1196 - protein, 12 aa, Artificial Sequence
  source: /note="Description of Artificial Sequence: Synthetic peptide"
GKSSGSGSESKS

SEQ ID NO: 1197 - protein, 14 aa, Artificial Sequence
  source: /note="Description of Artificial Sequence: Synthetic peptide"
GSTSGSGKSSEGKG

SEQ ID NO: 1198 - protein, 18 aa, Artificial Sequence
  source: /note="Description of Artificial Sequence: Synthetic peptide"
GSTSGSGKSSEGSGSTKG

SEQ ID NO: 1199 - protein, 18 aa, Artificial Sequence
  source: /note="Description of Artificial Sequence: Synthetic peptide"
GSTSGSGKPGSGEGSTKG

SEQ ID NO: 1200 - protein, 14 aa, Artificial Sequence
  source: /note="Description of Artificial Sequence: Synthetic peptide"
EGKSSGSGSESKEF

SEQ ID NO: 1201 - protein, 5 aa, Artificial Sequence
  source: /note="Description of Artificial Sequence: Synthetic peptide"
SRSSG

SEQ ID NO: 1202 - protein, 5 aa, Artificial Sequence
  source: /note="Description of Artificial Sequence: Synthetic peptide"
SGSSC

SEQ ID NO: 1203 - protein, 28 aa, Artificial Sequence
  source: /note="Description of Artificial Sequence: Synthetic peptide"
AMGRSGGGCAGNRVGSSLSCGGLNLQAM

SEQ ID NO: 1204 - protein, 15 aa, Artificial Sequence
  source: /note="Description of Artificial Sequence: Synthetic peptide"
GGGGSGGGGSGGGGS

SEQ ID NO: 1205 - protein, 4 aa, Artificial Sequence
  source: /note="Description of Artificial Sequence: Synthetic peptide"
GGGS

SEQ ID NO: 1206 - protein, 5 aa, Artificial Sequence
  source: /note="Description of Artificial Sequence: Synthetic peptide"
GGGGS

SEQ ID NO: 1207 - protein, 8 aa, Artificial Sequence
  source: /note="Description of Artificial Sequence: Synthetic peptide"
GGGGSGGG

SEQ ID NO: 1208 - protein, 7 aa, Artificial Sequence
  source: /note="Description of Artificial Sequence: Synthetic peptide"
GGSGGGG

SEQ ID NO: 1209 - protein, 18 aa, Artificial Sequence
  source: /note="Description of Artificial Sequence: Synthetic peptide"
GSTSGGGSGGGSGGGGSS

SEQ ID NO: 1210 - protein, 18 aa, Artificial Sequence
  source: /note="Description of Artificial Sequence: Synthetic peptide"
GSTSGSGKPGSSEGSTKG

SEQ ID NO: 1211 - protein, 4 aa, Artificial Sequence
  source: /note="Description of Artificial Sequence: Synthetic peptide"
GGGC

SEQ ID NO: 1212 - protein, 7 aa, Artificial Sequence
  source: /note="Description of Artificial Sequence: Synthetic peptide"
GGGGCGG

SEQ ID NO: 1213 - protein, 12 aa, Artificial Sequence
  source: /note="Description of Artificial Sequence: Synthetic peptide"
GGGGSGGGGCGG

SEQ ID NO: 1214 - protein, 12 aa, Artificial Sequence
  source: /note="Description of Artificial Sequence: Synthetic peptide"
GGGGCGGGGSGG

SEQ ID NO: 1215 - protein, 15 aa, Artificial Sequence
  source: /note="Description of Artificial Sequence: Synthetic peptide"
GGGGSGGGGSGGGGC

SEQ ID NO: 1216 - protein, 15 aa, Artificial Sequence
  source: /note="Description of Artificial Sequence: Synthetic peptide"
GGGGSGGGGCGGGGS

SEQ ID NO: 1217 - protein, 15 aa, Artificial Sequence
  source: /note="Description of Artificial Sequence: Synthetic peptide"
GGGGCGGGGCSGGGS

SEQ ID NO: 1218 - protein, 27 aa, Artificial Sequence
  source: /note="Description of Artificial Sequence: Synthetic peptide"
GGGGSGGGGCGGGGSSGGGGSSGGGGS

SEQ ID NO: 1219 - protein, 27 aa, Artificial Sequence
  source: /note="Description of Artificial Sequence: Synthetic peptide"
GGGGCGGGGSGGGGSSGGGGSSGGGGS

SEQ ID NO: 1220 - protein, 27 aa, Artificial Sequence
  source: /note="Description of Artificial Sequence: Synthetic peptide"
GGGGSGGGGSGGGGCSGGGGSSGGGGS

SEQ ID NO: 1221 - protein, 27 aa, Artificial Sequence
  source: /note="Description of Artificial Sequence: Synthetic peptide"
GGGGSGGGGSGGGGSCGGGGSSGGGGS

SEQ ID NO: 1222 - protein, 27 aa, Artificial Sequence
  source: /note="Description of Artificial Sequence: Synthetic peptide"
GGGGSGGGGSGGGGSSGGGGCSGGGGS

SEQ ID NO: 1223 - protein, 27 aa, Artificial Sequence
  source: /note="Description of Artificial Sequence: Synthetic peptide"
GGGGSGGGGSGGGGSSGGGGSCGGGGS

SEQ ID NO: 1224 - protein, 26 aa, Artificial Sequence
  source: /note="Description of Artificial Sequence: Synthetic peptide"
GGGGSGGGGSGGGGSGGGGSSGGGGC

SEQ ID NO: 1225 - protein, 4 aa, Artificial Sequence
  source: /note="Description of Artificial Sequence: Synthetic peptide"
GGGK

SEQ ID NO: 1226 - protein, 7 aa, Artificial Sequence
  source: /note="Description of Artificial Sequence: Synthetic peptide"
GGGGKGG

SEQ ID NO: 1227 - protein, 12 aa, Artificial Sequence
  source: /note="Description of Artificial Sequence: Synthetic peptide"
GGGGSGGGGKGG

SEQ ID NO: 1228 - protein, 12 aa, Artificial Sequence
  source: /note="Description of Artificial Sequence: Synthetic peptide"
GGGGKGGGGSGG

SEQ ID NO: 1229 - protein, 15 aa, Artificial Sequence
  source: /note="Description of Artificial Sequence: Synthetic peptide"
GGGGSGGGGSGGGGK

SEQ ID NO: 1230 - protein, 15 aa, Artificial Sequence
  source: /note="Description of Artificial Sequence: Synthetic peptide"
GGGGSGGGGKGGGGS

SEQ ID NO: 1231 - protein, 15 aa, Artificial Sequence
  source: /note="Description of Artificial Sequence: Synthetic peptide"
GGGGKGGGGCSGGGS

SEQ ID NO: 1232 - protein, 15 aa, Artificial Sequence
  source: /note="Description of Artificial Sequence: Synthetic peptide"
GGGGCGGGGKSGGGS

SEQ ID NO: 1233 - protein, 27 aa, Artificial Sequence
  source: /note="Description of Artificial Sequence: Synthetic peptide"
GGGGSGGGGKGGGGSSGGGGSSGGGGS

SEQ ID NO: 1234 - protein, 27 aa, Artificial Sequence
  source: /note="Description of Artificial Sequence: Synthetic peptide"
GGGGKGGGGSGGGGSSGGGGSSGGGGS

SEQ ID NO: 1235 - protein, 27 aa, Artificial Sequence
  source: /note="Description of Artificial Sequence: Synthetic peptide"
GGGGSGGGGSGGGGKSGGGGSSGGGGS

SEQ ID NO: 1236 - protein, 27 aa, Artificial Sequence
  source: /note="Description of Artificial Sequence: Synthetic peptide"
GGGGSGGGGSGGGGSKGGGGSSGGGGS

SEQ ID NO: 1237 - protein, 27 aa, Artificial Sequence
  source: /note="Description of Artificial Sequence: Synthetic peptide"
GGGGSGGGGSGGGGSSGGGGKSGGGGS

SEQ ID NO: 1238 - protein, 27 aa, Artificial Sequence
  source: /note="Description of Artificial Sequence: Synthetic peptide"
GGGGSGGGGSGGGGSSGGGGSKGGGGS

SEQ ID NO: 1239 - protein, 26 aa, Artificial Sequence
  source: /note="Description of Artificial Sequence: Synthetic peptide"
GGGGSGGGGSGGGGSGGGGSSGGGGK

The invention is claimed as follows:

1. A Shiga toxin effector polypeptide comprising the amino acid sequence of SEQ ID NO: 828.

2. A pharmaceutical composition comprising the polypeptide of claim 1 and a pharmaceutically acceptable carrier.

3. A method of treating cancer involving HER-2-expressing cells in a patient in need thereof, the method comprising the step of administering to the patient a therapeutically effective amount of the polypeptide of claim 1.

4. A method of treating cancer involving HER-2-expressing cells in a patient in need thereof, the method comprising the step of administering to the patient a therapeutically effective amount of the pharmaceutical composition of claim 2.

5. The method of claim 3, wherein the cancer is selected from the group consisting of breast cancer, gastrointestinal cancer, and colorectal cancer.

6. The method of claim 4, wherein the cancer is selected from the group consisting of breast cancer, gastrointestinal cancer, and colorectal cancer.

7. The method of claim 3, wherein said administering is via intravenous administration.

8. The method of claim 4, wherein said administering is via intravenous administration.

9. The method of claim 5, wherein said administering is via intravenous administration.

10. The method of claim 6, wherein said administering is via intravenous administration.

* * * * *